(12) United States Patent
Nandakumar et al.

(10) Patent No.: US 11,701,394 B2
(45) Date of Patent: Jul. 18, 2023

(54) COMPOSITIONS AND METHODS FOR TREATING CHOLESTATIC DISEASE

(71) Applicant: Seres Therapeutics, Inc., Cambridge, MA (US)

(72) Inventors: Madhumitha Nandakumar, Arlington, MA (US); Alice Peiyu Liou, Somerville, MA (US); Elizabeth Moritz Halvorsen, Malden, MA (US); Gregory McKenzie, Arlington, MA (US); Edward J. O'Brien, Arlington, MA (US); David Cook, Brookline, MA (US)

(73) Assignee: Seres Therapeutics, Inc., Cambridge, MA (US)

( * ) Notice: Subject to any disclaimer, the term of this patent is extended or adjusted under 35 U.S.C. 154(b) by 50 days.

(21) Appl. No.: 16/639,492

(22) PCT Filed: Aug. 14, 2018

(86) PCT No.: PCT/US2018/046769
§ 371 (c)(1),
(2) Date: Feb. 14, 2020

(87) PCT Pub. No.: WO2019/036510
PCT Pub. Date: Feb. 21, 2019

(65) Prior Publication Data
US 2021/0008128 A1 Jan. 14, 2021

Related U.S. Application Data

(60) Provisional application No. 62/545,298, filed on Aug. 14, 2017.

(51) Int. Cl.
*A61K 35/745* (2015.01)
*A61P 1/16* (2006.01)
*A61K 31/58* (2006.01)

(52) U.S. Cl.
CPC ............ *A61K 35/745* (2013.01); *A61K 31/58* (2013.01); *A61P 1/16* (2018.01)

(58) Field of Classification Search
None
See application file for complete search history.

(56) References Cited

U.S. PATENT DOCUMENTS

| | | |
|---|---|---|
| 3,009,861 A | 11/1961 | Alderton et al. |
| 3,009,864 A | 11/1961 | Webb |
| 3,228,838 A | 1/1966 | Rinfret et al. |
| 3,608,030 A | 9/1971 | Tint |
| 4,077,227 A | 3/1978 | Larson |
| 4,205,132 A | 5/1980 | Sandine et al. |
| 4,655,047 A | 4/1987 | Temple et al. |
| 4,689,226 A | 8/1987 | Nurmi et al. |
| 4,839,281 A | 6/1989 | Gorbach et al. |
| 5,196,205 A | 3/1993 | Borody |
| 5,425,951 A | 6/1995 | Goodrich, Jr. et al. |
| 5,436,002 A | 7/1995 | Payne et al. |
| 5,443,826 A | 8/1995 | Borody |
| 5,599,795 A | 2/1997 | McCann et al. |
| 5,648,206 A | 7/1997 | Goodrich, Jr. et al. |
| 5,951,977 A | 9/1999 | Nisbet et al. |
| 5,965,128 A | 10/1999 | Doyle et al. |
| 6,589,771 B1 | 7/2003 | Marshall |
| 6,645,530 B1 | 11/2003 | Borody |
| 7,326,551 B2 | 2/2008 | Maupin-Furlow et al. |
| 7,427,398 B2 | 9/2008 | Baillon et al. |
| 7,628,982 B2 | 12/2009 | Klaviniskis et al. |
| 7,632,520 B2 | 12/2009 | Khandelwal |
| 7,708,988 B2 | 5/2010 | Farmer |
| 7,731,976 B2 | 6/2010 | Cobb et al. |
| 7,763,420 B2 | 7/2010 | Stritzker et al. |
| 7,981,411 B2 | 7/2011 | Nadeau et al. |
| 7,998,473 B2 | 8/2011 | Boileau et al. |
| 8,021,654 B2 | 9/2011 | Rehberger et al. |
| 8,034,601 B2 | 10/2011 | Boileau et al. |
| 8,039,006 B2 | 10/2011 | Prato |
| 8,147,482 B2 | 4/2012 | Shimizu et al. |
| 8,187,590 B2 | 5/2012 | Farmer |
| 8,236,508 B2 | 8/2012 | Mutharasan et al. |
| 8,388,996 B2 | 3/2013 | Gehling et al. |
| 8,460,648 B2 | 6/2013 | Borody |
| 8,906,668 B2 | 12/2014 | Henn et al. |
| 8,968,721 B2 | 3/2015 | Harel |
| 9,028,841 B2 | 5/2015 | Henn et al. |
| 9,180,147 B2 | 11/2015 | McKenzie et al. |

(Continued)

FOREIGN PATENT DOCUMENTS

| | | |
|---|---|---|
| CN | 102131928 A | 7/2011 |
| CN | 102940652 A | 2/2013 |

(Continued)

OTHER PUBLICATIONS

Bathena, Sai Praneeth R., et al. "The profile of bile acids and their sulfate metabolites in human urine and serum." Journal of Chromatography B 942: 53-62 (Dec. 2013).

Chazouillères, Olivier. "Primary sclerosing cholangitis and bile acids." Clinics and research in hepatology and gastroenterology 36: S21-S25 (Sep. 2012).

Debruyne, Philip R., et al. "The role of bile acids in carcinogenesis." Mutation Research/Fundamental and Molecular Mechanisms of Mutagenesis 480: 359-369 (Sep. 2001).

Deleuze, J., et al. "Defect of multidrug-resistance 3 gene expression in a subtype of progressive familial intrahepatic cholestasis." Hepatology 23(4): 904-908 (Apr. 1996).

(Continued)

*Primary Examiner* — Brian Gangle
(74) *Attorney, Agent, or Firm* — Sterne Kessler Goldstein & Fox

(57) ABSTRACT

The invention provides compositions and methods for use in the treatment and prevention of cholestatic diseases.

17 Claims, 143 Drawing Sheets

Specification includes a Sequence Listing.

(56) References Cited

U.S. PATENT DOCUMENTS

| | | |
|---|---|---|
| 9,408,872 B2 | 8/2016 | Borody |
| 9,446,080 B2 | 9/2016 | McKenzie et al. |
| 9,533,014 B2 | 1/2017 | Henn et al. |
| 9,610,307 B2 | 4/2017 | Berry et al. |
| 9,808,519 B2 | 11/2017 | Honda et al. |
| 10,064,900 B2 | 9/2018 | Von Maltzahn et al. |
| 10,258,655 B2 | 4/2019 | Henn et al. |
| 10,864,235 B2 | 12/2020 | Henn et al. |
| 10,881,696 B2 | 1/2021 | Henn et al. |
| 10,967,011 B2 | 4/2021 | McKenzie et al. |
| 10,973,861 B2 | 4/2021 | Afeyan et al. |
| 11,185,562 B2 | 11/2021 | Cook et al. |
| 2001/0036453 A1 | 11/2001 | Reid et al. |
| 2004/0028689 A1 | 2/2004 | Borody |
| 2004/0170617 A1 | 9/2004 | Finegold |
| 2005/0048515 A1 | 3/2005 | Garner |
| 2005/0180962 A1 | 8/2005 | Raz et al. |
| 2006/0046246 A1 | 3/2006 | Zeng et al. |
| 2006/0067924 A1 | 3/2006 | Lee et al. |
| 2006/0188523 A1 | 8/2006 | Pei et al. |
| 2006/0233830 A1 | 10/2006 | Wong et al. |
| 2007/0141139 A1 | 6/2007 | Vandenberg |
| 2008/0213752 A1 | 9/2008 | Stave et al. |
| 2009/0197249 A1 | 8/2009 | Gillevet |
| 2010/0074872 A1 | 3/2010 | Blaser et al. |
| 2010/0215745 A1 | 8/2010 | Lazzari et al. |
| 2011/0081320 A1 | 4/2011 | Westall et al. |
| 2011/0113863 A1 | 5/2011 | Fuhrmann et al. |
| 2011/0189132 A1 | 8/2011 | Garner et al. |
| 2011/0280840 A1 | 11/2011 | Blaser et al. |
| 2011/0280847 A1 | 11/2011 | Sorg et al. |
| 2012/0020950 A1 | 1/2012 | Davis et al. |
| 2012/0021429 A1 | 1/2012 | Rublee et al. |
| 2012/0021921 A1 | 1/2012 | Scott et al. |
| 2012/0058094 A1 | 3/2012 | Blaser et al. |
| 2012/0064592 A1 | 3/2012 | O'Mullan et al. |
| 2012/0128633 A1 | 5/2012 | Veiga et al. |
| 2012/0128634 A1 | 5/2012 | Veiga et al. |
| 2012/0148629 A1 | 6/2012 | Holvoet et al. |
| 2012/0149584 A1 | 6/2012 | Olle et al. |
| 2012/0165215 A1 | 6/2012 | Andersen et al. |
| 2012/0177650 A1 | 7/2012 | Borody |
| 2012/0207726 A1 | 8/2012 | Lipkin et al. |
| 2012/0238468 A1 | 9/2012 | Tuk et al. |
| 2012/0264637 A1 | 10/2012 | Wiener-Kronish et al. |
| 2012/0276149 A1 | 11/2012 | Littman et al. |
| 2012/0276201 A1 | 11/2012 | Trachtman |
| 2012/0315249 A1 | 12/2012 | Olmstead |
| 2013/0017999 A1 | 1/2013 | Fremont et al. |
| 2013/0022575 A1 | 1/2013 | Cassity |
| 2013/0045274 A1 | 2/2013 | Hlavka |
| 2013/0045874 A1 | 2/2013 | Ehrlich |
| 2013/0065862 A1 | 3/2013 | Johnson |
| 2013/0115232 A1 | 5/2013 | Ferrara et al. |
| 2013/0121968 A1 | 5/2013 | Quay |
| 2013/0149339 A1 | 6/2013 | Honda et al. |
| 2013/0149375 A1 | 6/2013 | Geall |
| 2013/0195820 A1 | 8/2013 | Wacklin et al. |
| 2013/0266539 A1 | 10/2013 | Borody |
| 2014/0045744 A1 | 2/2014 | Gordon et al. |
| 2014/0135398 A1 | 5/2014 | Matar et al. |
| 2014/0147417 A1 | 5/2014 | Sadowsky et al. |
| 2014/0147425 A1 | 5/2014 | Henn et al. |
| 2014/0199281 A1 | 7/2014 | Henn et al. |
| 2014/0328803 A1 | 11/2014 | McKenzie et al. |
| 2014/0341921 A1 | 11/2014 | Honda et al. |
| 2014/0342438 A1 | 11/2014 | Allen-Vercoe et al. |
| 2014/0363397 A1 | 12/2014 | Allen-Vercoe et al. |
| 2015/0011415 A1 | 1/2015 | Levin et al. |
| 2015/0093360 A1 | 4/2015 | McKenzie et al. |
| 2015/0190435 A1 | 7/2015 | Henn et al. |
| 2016/0030494 A1* | 2/2016 | Henn .................. A61K 35/742 424/282.1 |
| 2016/0271188 A1 | 9/2016 | Berry et al. |
| 2017/0165302 A1 | 6/2017 | Henn et al. |
| 2018/0369297 A1† | 12/2018 | Karlsson |
| 2019/0192581 A1 | 6/2019 | Von Maltzahn et al. |
| 2019/0247447 A1 | 8/2019 | Button et al. |
| 2020/0276249 A1 | 9/2020 | O'Brien et al. |
| 2020/0353018 A1 | 11/2020 | Ford et al. |
| 2021/0008128 A1 | 1/2021 | Nandakumar et al. |
| 2021/0121505 A1 | 4/2021 | Nandakumar et al. |
| 2021/0169946 A1 | 6/2021 | Henn et al. |
| 2021/0169947 A1 | 6/2021 | Henn et al. |
| 2021/0169948 A1 | 6/2021 | Henn et al. |
| 2021/0169949 A1 | 6/2021 | Henn et al. |
| 2021/0196766 A1 | 7/2021 | Martinez et al. |
| 2021/0252079 A1 | 8/2021 | Matthew et al. |

FOREIGN PATENT DOCUMENTS

| | | | |
|---|---|---|---|
| DE | 102006062250 A1 | 6/2008 | |
| EA | 006847 B1 | 4/2006 | |
| EP | 0033584 A3 | 4/1982 | |
| EP | 0446069 A1 | 9/1991 | |
| EP | 0456418 A2 | 11/1991 | |
| EP | 0433299 A4 | 4/1992 | |
| EP | 0479820 B1 | 9/1994 | |
| EP | 1107772 B1 | 4/2006 | |
| EP | 1631312 B1 | 9/2008 | |
| EP | 2337569 A2 | 6/2011 | |
| EP | 2338989 A1 | 6/2011 | |
| EP | 2519108 A1 | 11/2012 | |
| EP | 2626076 A1 | 8/2013 | |
| EP | 2684469 A1 | 1/2014 | |
| EP | 2750682 B1 | 5/2016 | |
| JP | H0656679 A | 3/1994 | |
| JP | 2007332083 A | 12/2007 | |
| JP | 2010539179 A | 12/2010 | |
| JP | 5019563 B2 | 9/2012 | |
| RU | 2035186 C1 | 5/1995 | |
| RU | 2439145 C2 | 1/2012 | |
| WO | WO-9001335 A1 | 2/1990 | |
| WO | WO-9408598 A1 | 4/1994 | |
| WO | WO-9708598 A1 | 3/1997 | |
| WO | WO-9709886 A1 | 3/1997 | |
| WO | WO-9826787 A1 | 6/1998 | |
| WO | WO-0010582 A2 | 3/2000 | |
| WO | WO-0193904 A1 | 12/2001 | |
| WO | WO-0207741 A1 | 1/2002 | |
| WO | WO-0243649 A2 | 6/2002 | |
| WO | WO-2004069156 A2 * | 8/2004 | ........... A23L 1/3014 |
| WO | WO-2005017095 A2 | 2/2005 | |
| WO | WO-2005110445 A2 | 11/2005 | |
| WO | WO-2006012586 A2 | 2/2006 | |
| WO | WO-2007036230 A1 | 4/2007 | |
| WO | WO-2007136553 A2 | 11/2007 | |
| WO | WO-2008076696 A2 | 6/2008 | |
| WO | WO-2008077614 A2 | 7/2008 | |
| WO | WO-2008083157 A2 | 7/2008 | |
| WO | WO-2010030997 A1 | 3/2010 | |
| WO | WO-2010062369 A2 | 6/2010 | |
| WO | WO-2010124387 A1 | 11/2010 | |
| WO | WO-2010151842 A2 | 12/2010 | |
| WO | WO-2011005756 A1 | 1/2011 | |
| WO | WO-2011022542 A2 | 2/2011 | |
| WO | WO-2011022660 A1 | 2/2011 | |
| WO | WO-2011033310 A1 | 3/2011 | |
| WO | WO-2011043654 A1 | 4/2011 | |
| WO | WO-2011046616 A2 | 4/2011 | |
| WO | WO-2011060123 A1 | 5/2011 | |
| WO | WO 2011/152566 | 6/2011 | |
| WO | WO-2011094027 A1 | 8/2011 | |
| WO | WO-2011103123 A2 | 8/2011 | |
| WO | WO-2011107481 A2 | 9/2011 | |
| WO | WO-2011107482 A2 | 9/2011 | |
| WO | WO-2011113801 A1 | 9/2011 | |
| WO | WO-2011152566 A2 | 12/2011 | |
| WO | WO-2012009712 A2 | 1/2012 | |
| WO | WO-2012016287 A2 | 2/2012 | |
| WO | WO-2012033814 A2 | 3/2012 | |
| WO | WO-2012045150 A1 | 4/2012 | |
| WO | WO-2012064981 A2 | 5/2012 | |
| WO | WO-2012108830 A1 | 8/2012 | |

(56) References Cited

FOREIGN PATENT DOCUMENTS

| | | |
|---|---|---|
| WO | WO-2012116289 A2 | 8/2012 |
| WO | WO-2012122478 A1 | 9/2012 |
| WO | WO-2012122522 A2 | 9/2012 |
| WO | WO-2012142605 A1 | 10/2012 |
| WO | WO-2012148991 A1 | 11/2012 |
| WO | WO-2012159023 A2 | 11/2012 |
| WO | WO-2013016636 A1 | 1/2013 |
| WO | WO-2013019896 A1 | 2/2013 |
| WO | WO-2013032328 A1 | 3/2013 |
| WO | WO-2013037067 A1 | 3/2013 |
| WO | WO-2013037068 A1 | 3/2013 |
| WO | WO-2013050792 A1 | 4/2013 |
| WO | WO-2013053836 A1 | 4/2013 |
| WO | WO-2013080561 A1 | 6/2013 |
| WO | WO-2013166031 A1 | 11/2013 |
| WO | WO-2013171515 A1 | 11/2013 |
| WO | WO-2013176774 A1 | 11/2013 |
| WO | WO-2013177596 A2 | 11/2013 |
| WO | WO-2014082050 A1 | 5/2014 |
| WO | WO-2014121298 A2 | 8/2014 |
| WO | WO-2014121301 A1 | 8/2014 |
| WO | WO-2014121302 A2 | 8/2014 |
| WO | WO-2014121304 A1 | 8/2014 |
| WO | WO-2014145958 A2 | 9/2014 |
| WO | WO-2014153194 A2 | 9/2014 |
| WO | WO-2014177667 A1 | 11/2014 |
| WO | WO-2015018307 A1 | 2/2015 |
| WO | WO-2015077794 A1 | 5/2015 |
| WO | WO-2015095241 A2 | 6/2015 |
| WO | WO-2017091783 A2 | 6/2017 |
| WO | WO-2017102816 A1 * | 6/2017 .......... A61K 35/745 |
| WO | WO-2017160711 A1 | 9/2017 |
| WO | WO-2019089643 A1 | 5/2019 |

OTHER PUBLICATIONS

Duboc, Henri, et al. "Connecting dysbiosis, bile-acid dysmetabolism and gut inflammation in inflammatory bowel diseases." Gut 62(4): 531-539 (Apr. 2013).

Faubion, William A., et al. "Toxic bile salts induce rodent hepatocyte apoptosis via direct activation of Fas." The Journal of clinical investigation 103(1): 137-145 (Jan. 1999).

Fickert, Peter, et al. "A new xenobiotic-induced mouse model of sclerosing cholangitis and biliary fibrosis." The American journal of pathology 171(2): 525-536 (Aug. 2007).

Hofmann, Alan F. "The continuing importance of bile acids in liver and intestinal disease." Archives of internal medicine 159(22): 2647-2658 (Dec. 1999).

Hylemon, Phillip B., et al. "Bile acids as regulatory molecules." Journal of lipid research 50(8): 1509-1520 (Aug. 2009).

Kim, Insook, et al. "Spontaneous hepatocarcinogenesis in farnesoid X receptor-null mice." Carcinogenesis 28(5): 940-946 (May 2007).

Kohli, Rohit, et al. "Bile acid signaling: mechanism for bariatric surgery, cure for NASH?" Digestive diseases 33(3): 440-446 (May 2015).

Parés, Albert, Llorenç Caballería, and Juan Rodés. "Excellent long-term survival in patients with primary biliary cirrhosis and biochemical response to ursodeoxycholic acid." Gastroenterology 130(3): 715-720 (Mar. 2006).

Paumgartner, Gustav, and Ulrich Beuers. "Ursodeoxycholic acid in cholestatic liver disease: mechanisms of action and therapeutic use revisited." Hepatology 36(3): 525-531 (Sep. 2002).

Ridlon, Jason M., Dae-Joong Kang, and Phillip B. Hylemon. "Bile salt biotransformations by human intestinal bacteria." Journal of lipid research 47(2): 241-259 (Feb. 2006).

Sayin, Sama I., et al. "Gut microbiota regulates bile acid metabolism by reducing the levels of tauro-beta-muricholic acid, a naturally occurring FXR antagonist." Cell metabolism 17(2): 225-235 (Feb. 2013).

Setchell, K. D., et al. "Hepatic bile acid metabolism during early development revealed from the analysis of human fetal gallbladder bile." Journal of Biological Chemistry 263(32): 16637-16644 (Nov. 1988).

Sokol, Ronald J., et al. "Evidence for involvement of oxygen free radicals in bile acid toxicity to isolated rat hepatocytes." Hepatology 17(5): 869-881 (May 1993).

Tabibian, James H., et al. "Absence of the intestinal microbiota exacerbates hepatobiliary disease in a murine model of primary sclerosing cholangitis." Hepatology 63(1): 185-196 (Jan. 2016).

Trottier, Jocelyn, et al. "Metabolomic profiling of 17 bile acids in serum from patients with primary biliary cirrhosis and primary sclerosing cholangitis: a pilot study." Digestive and Liver Disease 44(4): 303-310 (Apr. 2012).

International Search Report and Written Opinion for Application No. PCT/US2018/046769, dated Nov. 22, 2018, 12 pages.

Seki Y., et al., "Two Neonatal Cholestasis Patients With Mutations in the Srd5b1 (Akr1d1) Gene: Diagnosis and Bile Acid Profiles During Chenodeoxycholic Acid Treatment," Journal of inherited metabolic disease 36(3):565-573, MTP Press, United states (May 2013).

Ziegler., "The Elucidation of the Structure of Hyocholic Acid," XP055521492, Retrieved from the Internet: URL: http://www.nrcresearchpress.comjdoijpdf/10.1139/v56-073, pp. 523 (Dec. 1955).

14th International Congress of Immunology, Kobe, Japan, International Immunology, Aug. 2010, 3 pages, vol. 22, Issue Suppl 1 Pt 3.

Aas, J., et al., "Recurrent Clostridium difficile Colitis: Case Series Involving 18 Patients Treated with Donor Stool Administered via a Nasogastric Tube," Clinical Infectious Diseases 36(5):580-585, Oxford University Press, United States (Mar. 2003).

Abrams, R.S., "Open-label, Uncontrolled Trial of Bowel Sterilization and Repopulation With Normal Bowel Flora for Treatment of Inflammatory Bowel Disease," Current Therapeutic Research 58(12):1001-1012, (Dec. 1997).

Abt, M.C., et al., "Commensal Bacteria Calibrate the Activation Threshold of Innate Antiviral Immunity," Immunity, 37(1):158-170, Cell Press, United States, ( Jul. 2012 ).

Abubucker, S.,et al., "Metabolic Reconstruction for Metagenomic Data and Its Application to the Human Microbiome.," Plos Computational Biology, 8(6):1002358, Public Library of Science,United States, (2012).

Accoceberry, I., et al., "One-step Purification of Enterocytozoon Bieneusi Spores From Human Stools by Immunoaffinity Expanded-bed Adsorption," Journal of Clinical Microbiology, 39(5):1947-1951, American Society for Microbiology, United States (May 2001).

Achtman, M., and Wagner, M, "Microbial Diversity and the Genetic Nature of Microbial Species," Nature Reviews. Microbiology, 6(6):431-440, Nature Publication Group, England (Jun. 2008).

Ahern et al., "The interleukin-23 axis m intestinal inflammation," Immunological Reviews 226:147-159 (2008).

Ahmad, T., et al., "Biomarkers of Myocardial Stress and Fibrosis as Predictors of Mode of Death in Patients With Chronic Heart Failure.," Jacc. Heart Failure, 2(3):260-268, Elsevier,United States, (Jun. 2014).

Allen-Vercoe, E., et al., "A Canadian Working Group Report on Fecal Microbial Therapy: Microbial Ecosystems Therapeutics," Canadian Journal of Gastroenterology, 26(7):457-462, Pulsus Group, Canada (Jul. 2012).

Allen-Vercoe, E., Strauss, J., and Chadee, K. (2011). Fusobacterium nucleatum: an emerging gut pathogen? Gut Microbes 2(5), 294-298.

Altschul, S.F., et al., "Basic Local Alignment Search Tool," Journal of Molecular Biology 215(3):403-410, Elsevier, England (Oct. 1990).

Altschul, S.F., et al., "Gapped BLAST and PSI-BLAST: A New Generation of Protein Database Search Programs," Nucleic Acids Research 25(17):3389-3402, Oxford University Press, England (Sep. 1997).

Anderson, K.F., et al., "Evaluation of Methods to Identify the Klebsiella Pneumoniae Carbapenemase in Enterobacteriaceae," Journal of Clinical Microbiology, 45(8):2723-2725, American Society for Microbiology, United States (Aug. 2007).

Andoh, A., et al., "Terminal Restriction Fragment Polymorphism Analyses of Fecal Microbiota in Five Siblings Including Two with Ulcerative Colitis," Gastroenterology 2(5):343-345, Springer Japan (Oct. 2009).

(56) References Cited

OTHER PUBLICATIONS

Anonymous, "Ecobiotic Drugs," Seres Therapeutics, Oct. 22, 2015,http://web.archive.org/web/20151022091731 /http://web.archive.org/web/2015lecobiotic-drugs, retrieved Mar. 7, 2017 (3 pages).

Anonymous, "Microbiome Therapeutics Platform," Seres Therapeutics, Retrieved on [Oct. 23, 2015], Retrieved from (http:/ /web.arch ive.org/web/20 151023063153/), Retrieved from (http://www.serestherapeutics.com/ou rscience/ microbiome-therapeutics-platform), Retrieved on [Mar. 7, 2017], 3 pages.

Anonymous, "Product Pipeline," Seres Therapeutics, Oct. 22, 2015], Retrieved from (<http: web.="" arch="" ive.org="" web="" 20="" 151="" 022091722="" http:="" http://www.serestherapeutics.com/pipeline/products)</http:>, Retrieved on [Mar. 7, 2017], (3 pages).

Arpaia, N., et al., "Metabolites Produced by Commensal Bacteria Promote Peripheral Regulatory T-cell Generation," Nature 504(7480):451-455, Nature Publishing Group, England (Dec. 2013).

Arumugam, M., et al., "Enterotypes of the Human Gut Microbiome," Nature, 473(7346):174-180, Macmillan Journals Limited, England (May 2011).

ASBMT RFI 2016—Disease Classifications Corresponding to CIBMTR Classifications. 2016.

Atarashi, K., et al., "Induction of Colonic Regulatory T Cells by Indigenous *Clostridium* Species," Science 331(6015):337-341, American Association for the Advancement of Science, United States (Jan. 2011) including supplemental data.

Atarashi, K. et al., Supporting Online Material for "Induction of Colonic Regulatory T Cells by Indigenous *Clostridium* Species," Science Express, Dec. 23, 2010, 26 pages.

Atarashi, K., et al., "Treg Induction by a Rationally Selected Mixture of Clostridia Strains From the Human Microbiota," Nature 500(7461):232-236, Nature Publishing Group, England (Aug. 2013) including supplemental data.

Atta, "Gene therapy for liver regeneration: Experimental studies and prospects for clinical trials," World J Gastroenterol., 16(32):4019-4030 (2010).

Australian First Examination Report, Australian Application No. 2013347805, dated Apr. 13, 2017, 3 pages.

Australian First Examination Report, Australian Application No. 2014212004, dated Sep. 21, 2017, 6 pages.

Australian First Examination Report, Australian Application No. 2014232370, dated Oct. 19, 2017,4 pages.

Autoimmune Disease List, There Are More Than 100 Autoimmune Diseases, American Autoimmune Related Diseases Association, AARDA, Inc., 2014, 4 pages.

Babel, N.et al., "Analysis ofT Cell Receptor Repertoire by Newly Established CDR3 High-Throughput Sequencing Allows for Monitoring/Tracing of Antigen-Specific T Cells in Peripheral Blood and Tissue," pp. 063-09, 141h ICI Abstract Book, 141h International Congress of Immunology, 2010, 3 pages.

Bacigalupo, A.,et al., "Defining the Intensity of Conditioning Regimens: Working Definitions.," Biology of Blood and Marrow Transplantation : Journal of the American Society for Blood and Marrow Transplantation, 15(12):1628-1633, Carden Jennings Publishing, United States, (Dec. 2009).

Backhed, F., et al., "The Gut Microbiota as an Environmental Factor That Regulates Fat Storage," Proceedings of the National Academy of Sciences of the United States of America, 101(44):15718-15723, National Academy of Sciences, United States (Nov. 2004).

Bader, J., Albin, A., and Stahl, U. (2012). Spore-forming bacteria and their utilisation as probiotics. Benef Microbes 3(1), 67-75.

Bajaj, J.S.,et al., "Colonic Mucosal Microbiome Differs From Stool Microbiome in Cirrhosis and Hepatic Encephalopathy and is Linked to Cognition and Inflammation.," American Journal of Physiology. Gastrointestinal and Liver Physiology, 303(6):75-85, American Physiological Society, United States, (Sep. 2012).

Bakken, J.S., et al., "Treating Clostridium Difficile Infection With Fecal Microbiota Transplantation," Clinical Gastroenterology and Hepatology 9(12):1044-1049, Saunders for the American Gastroenterological Association, United States (Dec. 2011).

Bakken, J.S., "Fecal Bacteriotherapy for Recurrent Clostridium Difficile Infection," Anaerobe 15(6):285-289, Academic Press, England (Dec. 2009).

Barrasa, J.I., et al., "Bile Acids in the Colon, From Healthy to Cytotoxic Molecules.," Toxicology in Vitro : an International Journal Published in Association With Bibra, 27(2):964-977, Pergamon Press , England, (Mar. 2013).

Barreau, M., et al., "Improving the Identification of Anaerobes in the Clinical Microbiology Laboratory Through MALDI-TOF Mass Spectrometry," Anaerobe, 22:123-125, Academic Press, England (Aug. 2013).

Barrell, C.,et al., "Reduced-intensity Conditioning Allogeneic Stem Cell Transplantation in Pediatric Patients and Subsequent Supportive Care.," Oncology Nursing Fomm, 39(6):451-458, Oncology Nursing Society,United States, (Nov. 2012).

Bartlett, J.G., et al., "Antibiotic-associated Pseudomembranous Colitis Due to Toxin-Producing Clostridia," The New England journal of medicine, 298(10):531-534, Massachusetts Medical Society, United States , (Mar. 1978 ).

Basler, M., et al., "Tit-for-tat: Type Vi Secretion System Counterattack During Bacterial Cell-cell Interactions," Cell, 152(4):884-894, Cell Press, United States, (Feb. 2013 ).

Basler, M., et al., "Type Vi Secretion Requires a Dynamic Contractile Phage Tail-like Structure," Nature, 483(7388):182-186, Nature Publishing Group, England, (Feb. 2012 ).

Bauer, T.M., et al., "Derivation and Validation of Guidelines for Stool Cultures for Enteropathogenic Bacteria Other Than Clostridium Difficile in Hospitalized Adults," JAMA, 285(3:313-319, American Medical Association, United States (Jan. 2001).

Beelen et al., "Influence of Intestinal Bacterial Decontamination Using Metronidazole and Ciprofloxacin or Ciprofloxacin Alone on the Development of Acute Graft-Versus-Host Disease After Marrow Transplantation in Patients with Hematologic Malignancies: Final Results and Long-Term Follow-Up of an Open-Label Prospective Randomized Trial," Blood 93(10):3267-3275 (1999).

Begley et al., "Bile Salt Hydrolase Activity in Probiotics," Appl. Environ Microbial. 72(3): I729-173 8 (2006).

Belkaid, Y, and Rouse, B,T., "Natural Regulatory T Cells in Infectious Disease," Nature Immunology 6(4):353-360, Nature America Inc, United States (Apr. 2005).

Ben-Amor, K., et al., "Genetic Diversity of Viable, Injured, and Dead Fecal Bacteria Assessed by Fluorescence-activated Cell Sorting and 16S rRNA Gene Analysis," Applied and Environmental Microbiology, 71(8):4679-4689, American Society for Microbiology, United States (Aug. 2005).

Bernstein, H., et al., "Bile Acids as Carcinogens in Human Gastrointestinal Cancers.," Mutation research, 589(1):47-65, Elsevier, Netherlands, (Jan. 2005).

Berst Ad, A., et al., "Fecal Fat Determination With a Modified Titration Method," Scandinavian Journal of Gastroenterology, 45(5):603-607, Informa Healthcare, England (May 2010).

Bhatia, A. et al., "Proionibacterium Acnes and Chronic Diseases," The Infectious Etiology of Chronic Diseases: Defining the Relationship, Enhancing the Research, and Mitigating the Effects: Workshop Summary., Knobler, S.L. et al. (eds.), 2004, pp. 74-80, may be downloaded at (URL:http://www.nap.edu/catalog/11026.html).

Bidawid, S., et al., "Heat Inactivation of Hepatitis a Virus in Dairy Foods," Journal of Food Protection, 63(4):522-528, International Association for Food Protection, United States (Apr. 2000).

Bloedt, K., et al., "Evaluation of New Selective Culture Media and a Rapid Fluorescence in Situ Hybridization Assay for Identification of Clostridium Difficile From Stool Samples," Journal of Medical Microbiology, 58(7):874-877, Microbiology Society, England (Jul. 2009).

Bokulich, N.A., et al., "Quality-filtering Vastly Improves Diversity Estimates From Illumina Amplicon Sequencing," Nature Methods, 10(1):57-59, Nature Publications Group, United States (Jan. 2013).

Bolger, A.M.,et al., "Trimmomatic: a Flexible Trimmer for Illumina Sequence Data.," Bioinformatics (Oxford, England), 30(15):2114-2120, Oxford University Press,England, (Aug. 2014).

Bolivar, I., et al., "Bacterial Diversity in Oral Samples of Children in Niger With Acute Noma, Acute Necrotizing Gingivitis, and

(56) References Cited

OTHER PUBLICATIONS

Healthy Controls," Plos Neglected Tropical Diseases, 6(3):e1556, Public Library of Science, United States (2012).
Borody, T.J., and Khoruts, A, "Fecal Microbiota Transplantation and Emerging Applications," Nature Reviews. Gastroenterology & Hepatology, 9(2):88-96, Nature Publication Group, England (Feb. 2012).
Borody, T.J. et al. (2011). Fecal microbiota transplantation (FMT) in multiple sclerosis. Poster abstract at American College of Gastroenterology Annual Scientific Meeting and Postgraduate Course Oct. 28, 2011.
Borody, T,J., et al., "Treatment of Ulcerative Colitis Using Fecal Bacteriotherapy," Journal of Clinical Gastroenterology 37(1):42-47, Wolters Kluwer Health, Inc, United States (Jul. 2003).
Borriello, S.P., and Barclay, F.E, "An In-Vitro Model of Colonisation Resistance to Clostridium Difficile Infection," Journal of Medical Microbiology, 21(4):299-309, Microbiology Society, England (Jun. 1986).
Borriello, S.P., and Barclay, F.E, "Protection of Hamsters Against Clostridium Difficile Ileocaecitis by Prior Colonisation With Non-pathogenic Strains," Journal of Medical Microbiology, 19(3):339-350, Microbiology Society,England (Jun. 1985).
Borriello, S.P., and Honour, P, "Simplified Procedure for the Routine Isolation of Clostridium Difficile From Faeces," Journal of Clinical Pathology, 34(10):1124-1127, BMJ Publication Group, England (Oct. 1981).
Borriello, S.P., "The Influence of the Normal Flora on Clostridium Difficile Colonisation of the Gut," Annals of Medicine, , 22(1):61-67, Informa Healthcare, England (Feb. 1990).
Boyles, W.A., and Lincoln, R.E, "Separation and Concentration of Bacterial Spores and Vegetative Cells by Foam Flotation," Applied Microbiology, 6(5):327-334, American Society For Microbiology, United States (Sep. 1958).
Brandl et al., "Vancomycin-resistant enterococci exploit anti biotic-induced innate immune deficit,". Nature 455(7214):804-807 (2008).
Brandt, L.J., et al., "Long-term Follow-up of Colonoscopic Fecal Microbiota Transplant for Recurrent Clostridium Difficile Infection," The American Journal of Gastroenterology, 107(7):1079-1087, Wolters Kluwer Health, United States (Jul. 2012).
Brandt, L.J., "Fecal Transplantation for the Treatment of Clostridium Difficile Infection," Gastroenterology & Hepatology, 8(3):191-194, Gastro-Hep Communications, United States (Mar. 2012).
Brauniger, S., et al., "Further Studies on Thermal Resistance of Bovine Parvovirus Against Moist and Dry Heat," International Journal of Hygiene and Environmental Health, 203(1):71-75, Urban & Fischer, Germany (Mar. 2000).
Britton, R.A., et al., "Role of the Intestinal Microbiota in Resistance to Colonization by Clostridium Difficile," Gastroenterology 146(6):1547-1553, W.B. Saunders, United States (May 2014).
Broda, D.M., et al., "Efficacy of Heat and Ethanol Spore Treatments for the Isolation of Psychrotrophic *Clostridium* Spp. Associated With the Spoilage of Chilled Vacuum-packed Meats," International Journal of Food Microbiology, 39(1-2):61-68, Elsevier Science Publishers, Netherlands (Jan. 1998).
Brosius, J., et al., "Complete Nucleotide Sequence of a 16S Ribosomal RNA Gene From *Escherichia coli*," Proceedings of the National Academy of Sciences of the United States of America, 75(10):4801-4805, National Academy of Sciences, United States (Oct. 1978).
Browne, H,P., et al., "Culturing of 'unculturable' Human Microbiota Reveals Novel Taxa and Extensive Sporulation," Nature 533(7604):543-546, Nature Publishing Group, England (May 2016).
Bueche, M., et al., "Quantification of Endospore-forming Firmicutes by Quantitative PCR With the Functional Gene Spo0A," Applied and Environmental Microbiology 79(17):5302-5312, American Society for Microbiology, United States (Sep. 2013).
Buffie, C. G., et al., "Precision Microbiome Reconstitution Restores Bile Acid Mediated Resistance to Clostridium Difficile," Nature 517(7533):205-208, Nature Publishing Group, England (Jan. 2015).

Buffie, C.G. and Pamer, E.G., "Microbiota-mediated Colonization Resistance Against Intestinal Pathogens," Nature Reviews. Immunology 13(11):790-801, Nature Pub. Group, England (Nov. 2013).
Buffie, C.G., et al., "Profound Alterations of Intestinal Microbiota Following a Single Dose of Clindamycin Results in Sustained Susceptibility to Clostridium Difficile-induced Colitis," Infection and Immunity, 80(1):62-73, American Society For Microbiology, United States, (Jan. 2012 ).
Burke, C.J., et al., "Formulation, Stability, and Delivery of Live Attenuated Vaccines for Human Use," Critical Reviews in Therapeutic Drug Carrier Systems, 16(1):1-83, Begell House, United States (1999).
Caballero, S. et al. "Distinct but Spatially Overlapping Intestinal Niches for Vancomycin-Resistant Enterococcus faecium and Carbapenem-Resistant Klebsiella Pneumoniae" PLoS Pathogens 11(9):e1005132, Public Library of Science, United States (2015).
Cani, P.D., et al., "Changes in Gut Microbiota Control Inflammation in Obese Mice Through a Mechanism Involving Glp-2-driven Improvement of Gut Permeability," Gut, 58(8):1091-1103, British Medical Association, England (Aug. 2009).
Caporaso, J.G., et al., "QIIMEAllows Analysis of High-throughput Community Sequencing Data," Nature Methods, 7(5):335-336, Nature Publishing Group, United States, (May 2010 ).
Caporaso, J.G., et al., "Ultra-High-Throughput Microbial Community Analysis on the Illumina Hiseq and Miseq Platforms," The Isme Journal, 6(8):1621-1624, Nature Publishing Group, England, (Aug. 2012).
Carlier, J.P., et al., "Proposal to Unify Clostridium Orbiscindens Winter et al. 1991 and Eubacterium Plautii (Séguin 1928) Hofstad and Aasjord 1982, With Description of *Flavonifractor plautii* Gen. Nov., Comb. Nov., and Reassignment of Bacteroides Capillosus to *Pseudoflavonifractor capillosus* Gen. Nov., Comb. Nov.," International Journal of Systematic and Evolutionary Microbiology 60(Pt 3):585-590, Microbiology Society, England (Mar. 2010).
Carvalho, A. S., et al., "Effects of Various Sugars Added to Growth and Drying Media Upon Thermotolerance and Survival Throughout Storage of Freeze-dried *Lactobacillus delbrueckii* ssp *bulgaricus*," Biotechnology Progress, 20(1):248-254, Wiley-Blackwell, United States (Jan. 2004).
Casula, G. and Cutting, S.M., "Bacillus Probiotics: Spore Germination in the Gastrointestinal Tract," Applied and Environmental Microbiology 68(5):2344-2352, American Society for Microbiology, United States (May 2002).
Cato, E.P., et al., "*Clostridium oroticum* Comb. Nov. Amended Description," International Journal of Systematic and Evolutionary Microbiology 17(1):9-13, (Jan. 1968).
Certified translation of second priority document, PCT/JP2010/071746, 79 pages, Dec. 27, 2017.
Champagne, C.P., et al., "Effect of Polymers and Storage Temperature on the Stability of Freeze-dried Lactic Acid Bacteria," Food Research International, 29(5-6):555-562 (Jun.-Aug. 1996).
Chang, J.Y., et al., "Decreased Diversity of the Fecal Microbiome in Recurrent Clostridium Difficile-Associated Diarrhea," The Journal of Infectious Diseases 197(3):435-438, Oxford University Press, United States (Feb. 2008).
Chapman, C.M.C., et al., "In Vitro Evaluation of Single- and Multi-strain Probiotics: Inter-species Inhibition Between Probiotic Strains, and Inhibition of Pathogens," Anaerobe, 18(4):405-413, Academic Press, England (Aug. 2012).
Chen, W.,et al., "Human Intestinal Lumen and Mucosa-associated Microbiota in Patients With Colorectal Cancer.," Plos One, 7(6):3 9743, Public Library of Science,United States, (2012).
Chen, X., et al., "A Mouse Model of Clostridium Difficile-associated Disease," Gastroenterology, 135(6):1984-1992, W.B. Saunders, United States (Dec. 2008).
Chen, X., et al., "Overview of Clostridium Difficile Infection: Implications for China," Gastroenterology Report, 1(3):153-158, Oxford University Press and Science Digestive, England, (Nov. 2013).
Chinese First Office Action, Chinese Application No. 2013 80071190X, Jul. 4, 2018, 11 pages (with a concise explanation of relevance).
Chinese First Office Action, Chinese Application No. 201480019395. 8, dated Jul. 17, 2017, 29 pages.

(56) References Cited

OTHER PUBLICATIONS

Chinese Second Office Action, Chinese Application No. 201480019395.8, dated Apr. 4, 2018 (with concise explanation of relevance), 14 pages.

Chiu, C-H. and Ou, J-T, "Rapid Identification of *Salmonella serovars* in Feces by Specific Detection of Virulence Genes, Inva and Spvc, by an Enrichment Broth Culture-multiplex Pcr Combination Assay," Journal of Clinical Microbiology, 34(10):2619-2622, American Society for Microbiology, United States (Oct. 1996).

Chow, J., Tang, H., and Mazmanian, S.K, "Pathobionts of the Gastrointestinal Microbiota and Inflammatory Disease," Current opinion in immunology, 23(4):473-480, Elsevier, England (Aug. 2011).

Chromek, M.,et al., "The Antimicrobial Peptide Cathelicidin Protects Mice From *Escherichia coli* O157:h7-mediated Disease.," Plos One, 7(10):46476, Public Library of Science,United States, (2012).

Chung, H., et al., "Gut Immune Maturation Depends on Colonization With a Host-specific Microbiota," Cell 149(7):1578-1593, Cell Press, United States (Jun. 2012).

Claesson, M.J., et al., "Comparison of Two Next-generation Sequencing Technologies for Resolving Highly Complex Microbiota Composition Using Tandem Variable 16S rRNA Gene Regions," Nucleic Acids Research, 3 8(22):e200, Oxford University Press, England (Dec. 2010).

Clemente, J.C., et al., "The Impact of the Gut Microbiota on Human Health: an Integrative View," Cell, 148(6):1258-1270, Cell Press, United States (Mar. 2012).

Clifford, R.J., et al., "Detection of Bacterial 16s Rrna and Identification of Four Clinically Important Bacteria by Real-time Pcr.," Plos One, 7(11):48558, Public Library of Science,United States, (2012).

Cohen, Statistical Power Analysis for the Behavioral Sciences, Second Edition (Routledge, Hillsdale, NJ, 1988).

Coleman, W.H., "Mechanism of Killing of Spores of Bacillus Cereus and Bacillus Megaterium by Wet Heat," Letters in Applied Microbiology, 50(5):507-514, Blackwell Scientific Publications, England (May 2010).

Collins, M,D., et al., "The Phylogeny of the Genus *Clostridium*: Proposal of Five New Genera and Eleven New Species Combinations," International Journal of Systematic Bacteriology 44(4):812-826, Society for General Microbiology, England (Oct. 1994).

Cooke et al., "LPS antagonism reduces graft-versus-host disease and preserves graftversus-leukemia activity after experimental bone marrow transplantation," J. Clin. Invest. 107:1581-1589 (2001).

Cooke, K.R.,et al., "An Experimental Model of Idiopathic Pneumonia Syndrome After Bone Marrow Transplantation: I. The Roles of Minor H Antigens and Endotoxin.," Blood, 88(8):3230-3239, American Society of Hematology,United States, (Oct. 1996).

Copelan, E.,et al., "A Scheme for Defining Cause of Death and Its Application in the T Cell Depletion Trial.," Biology of Blood and Marrow Transplantation : Journal of the American Society for Blood and Marrow Transplantation, 13(12):1469-1476, Carden Jennings Publishing,United States, (Dec. 2017).

Cotten, M., et al., "Receptor-mediated Transport of DNA Into Eukaryotic Cells," Methods in Enzymology 217:618-644, Academic Press, United States (1993).

Cover Page of Science, Jan. 21, 2011, 1 page.

Cruz, M. C., et al., "Immunosuppressive and Nonimmunosuppressive Cyclosporine AnalogsAre Toxic to the Opportunistic Fungal Pathogen Cryptococcus neoformans via Cyclophilin-Dependent Inhibition of Calcineurin," Antimicrob. Agents Chemother. 44(1):143-149, American Society for Microbiology (2000).

Cunliffe, R.N. and Scott, B.B., "Review Article: Monitoring for Drug Side-effects in Inflammatory Bowel Disease," Alimentary Pharmacology & Therapeutics 16(4):647-662, Wiley-Blackwell, England (Apr. 2002).

Current Uses and Outcomes of Hematopoietic Stem Cell Transplantation 2012 CIBMTR Summary Slides, 2012.

Dabard J., et al., "Ruminococcin A, a New lantibiotic Produced by a Ruminococcus Gnavus Strain Isolated from Human Feces," Applied and Environmental Microbiology, 67(9):4111-4118, American Society for Microbiology, United States (Sep. 2001).

Das et al., "Blockade ofinterleukin-23 signaling results in targeted protection ofthe colon and allows for separation of graft-versus-host and graft-versus-leukemia responses," Blood 115(25):5249-5258 (2010).

Das, R.,et al., "Interleukin-23 Secretion by Donor Antigen-presenting Cells is Critical for Organ-specific Pathology in Graft-versus-host Disease.," Blood, 113(10):2352-2362, American Society of Hematology,United States, (Mar. 2009).

David, L.A., Maurice, C.F., Carmody, R.N., Gootenberg, D.B., Button, J.E., Wolfe, B.E., Ling, A.V., Devlin, A.S., Varma, Y., Fischbach, M.A., et al. (2013). Diet rapidly and reproducibly alters the human gut microbiome. Nature advance online publication.

Day 3: 14th International Congress of Immunology, Aug. 22-27, 2010, Japan, 3 page.

De Aguiar Vallim, T.Q., et al., "Pleiotropic Roles of Bile Acids in Metabolism," Cell Metabolism, 17(5):657-669, Cell Press, United States, (May 2013).

Deangelis, M., et al., "Fecal Microbiota and Metabolome of Children With Autism and Pervasive Developmental Disorder Not Otherwise Specified," PloS One, 8(10):e76993, Public Library of Science, United States (Oct. 2013).

Defined Fecal Microbiota Transplantation for Clostridium Difficile Diarrhea. (http://clinicaltrials.gov/ct2/show/NCT01868373); Accessed Mar. 26, 2014.

Delay, M.L.,et al., "Hla-b27 Misfolding and the Unfolded Protein Response Augment Interleukin-23 Production and Are Associated With Th17 Activation in Transgenic Rats.," Arthritis and Rheumatism, 60(9):2633-2643, Hoboken, N.J. : Wiley-Blackwell,United States, (Sep. 2009).

Dendukuri, N., "Probiotic Therapy for the Prevention and Treatment of Clostridium Difficile-associated Diarrhea: A Systematic Review," Canadian Medical Association Journal, 173(2):167-170, Canadian Medical Association, Canada (Jul. 2005).

Derrien, M., "*Akkermansia muciniphila* Gen. Nov., Sp. Nov., a Human Intestinal Mucin-degrading Bacterium," International Journal of Systematic and Evolutionary Microbiology, 54(5):1469-1476, Microbiology Society, England (Sep. 2004).

Derrien, M.,et al., "Modulation of Mucosal Immune Response, Tolerance, and Proliferation in Mice Colonized by the Mucin-degrader Akkermansia Muciniphila.," Frontiers in Microbiology, 2:166, Frontiers Research Foundation,Switzerland., (Aug. 2011).

Derrien, M.,et al., "Mucin-bacterial Interactions in the Human Oral Cavity and Digestive Tract.," Gut Microbes, 1(4):254-268, PA : Taylor & Francis, United States, (Jul. 2010).

DeSantis, T.Z.,et al., "Greengenes, a Chimera-Checked 16S rRNA Gene Database and Workbench Compatible With Arb.," Applied and Environmental Microbiology, 72(7):5069-5072, American Society for Microbiology,United States, (Jul. 2006).

Dethlefsen, L., et al., "Incomplete Recovery and Individualized Responses of the Human Distal Gut Microbiota to Repeated Antibiotic Perturbation," Proceedings of the National Academy of Sciences of the United States of America, 108 Suppl 1:4554-4561, National Academy of Sciences, United States, (Mar. 2011).

Dethlefsen, L., "The Pervasive Effects of an Antibiotic on the Human Gut Microbiota, as Revealed by Deep 16S rRNA Sequencing," PLoS Biology, 6(11):e280, Public Library of Science, United States (Nov. 2008).

Detmer, A., and Glenting, J., "Live Bacterial Vaccines—A Review and Identification of Potential Hazards," Microbial Cell Factories, 5:23, BioMed Central, England (Jun. 2006).

Devos, W.M., "Fame and Future of Faecal Transplantations-developing Next-generation Therapies With Synthetic Microbiomes," Microbial Biotechnology, 6(4):316-325, Wiley-Blackwell, United States (Jul. 2013).

Dewhirst, F.E., et al., "Phylogeny of the Defined Murine Microbiota: Altered Schaedler Flora," Applied and Environmental Microbiology 65(8):3287-3292, American Society for Microbiology, United States (Aug. 1999).

(56) References Cited

OTHER PUBLICATIONS

Dezfulian, M., et al., "Selective Medium for Isolation of Clostridium Botulinum From Human Feces," Journal of Clinical Microbiology, 13(3):526-531, American Society for Microbiology, United States (Mar. 1981).
Dharmani, P., et al., "The Probiotic Mixture VSL#3 Accelerates Gastric Ulcer Healing by Stimulating Vascular Endothelial Growth Factor," PloS One , 8(3):e58671, Public Library of Science, United States (Mar. 2013).
Diehl, G.E., et al., "Microbiota Restricts Trafficking of Bacteria to Mesenteric Lymph Nodes by Cx(3)cr1(Hi) Cells," Nature, 494(7435):116-120, Nature Publishing Group, England, (Feb. 2013).
Dietrich, G., Collioud, A., and Rothen, S.A. (2008). Developing and Manufacturing Attenuated Live Bacterial Vaccines. (http://www.biopharminternational.com/biopharm/Vaccine+Manufacturing+Articles/Developing-and-Manufacturing-Attenuated-Live-Bacte/ArticleStandard/Article/detail/557306) Accessed Mar. 25, 2014.
D'Souza, D.H., and Su, X, "Efficacy of Chemical Treatments Against Murine Norovirus, Feline Calicivirus, and MS2 Bacteriophage," Foodborne Pathogens and Disease, 7(3):319-326, Mary Ann Liebert, incorporated, United States (Mar. 2010).
Dowell, V.R., et al., "Coproexamination for Botulinal Toxin and Clostridium Botulinum. A New Procedure for Laboratory Diagnosis of Botulism," JAMA, 238(17):1829-1832, American Medical Association, United States (Oct. 1977).
Dragon, D.C., and Rennie, R.P, "Evaluation of Spore Extraction and Purification Methods for Selective Recovery of Viable Bacillus Anthracis Spores," Letters in Applied Microbiology, 33(2):100-105, Blackwell Scientific Publications, England (Aug. 2001).
Duan, J., et al., "Microbial Colonization Drives Expansion of Il-1 Receptor 1-expressing and Il-17-producing Gamma/delta T Cells," Cell host & microbe, 7(2):140-150, Cell Press, United States, (Feb. 2010).
Duc, L., et al., "Germination of the Spore in the Gastrointestinal Tract Provides a Novel Route for Heterologous Antigen Delivery," Vaccine, 21(27-30):4215-4224, Elsevier Science, Netherlands (Oct. 2003).
Duc, L.H., et al., "Characterization of Bacillus Probiotics Available for Human Use," Applied and Environmental Microbiology 70(4):2161-2171, American Society for Microbiology, United States (Apr. 2004).
Duc, L.H., et al., "Bacterial Spores as Vaccine Vehicles," Infection and Immunity, 71(5):2810-2818, American Society For Microbiology, United States (May 2003).
Dumas, M.E., et al., "Metabolic Profiling Reveals a Contribution of Gut Microbiota to Fatty Liver Phenotype in Insulin-resistant Mice," Proceedings of the National Academy of Sciences of the United States of America, 103(33):12511-12516, National Academy of Sciences, United States (Aug. 2006).
Duncker, S.C.,et al., "The D-alanine Content of Lipoteichoic Acid is Crucial for Lactobacillus Plantarum-mediated Protection From Visceral Pain Perception in a Rat Colorectal Distension Model.," Neurogastroenterology and Motility : the Official Journal of the European Gastrointestinal Motility Society, 20(7):843-850, Blackwell Scientific Publications, c1994, England, (Jul. 2008).
Dutta, S.K., et al., "Efficacy of Combined Jejunal and Colonic Fecal Microbiota Transplantation for Recurrent Clostridium Difficile Infection," Clinical Gastroenterology and Hepatology, 12(9):1572-1576, W.B. Saunders for the American Gastroenterological Association, United States (Sep. 2014).
E. Meyers and W. Miller (CABIOS, 4: 11-17 (1989)).
Edgar, R.C., et al., "Uchime Improves Sensitivity and Speed of Chimera Detection," Bioinformatics, 27(16):2194-2200, Oxford University Press, England, (Aug. 2011).
Edwards, A.D., and Slater, N.K.H, "Formulation of a Live Bacterial Vaccine for Stable Room Temperature Storage Results in Loss of Acid, Bile and Bile Salt Resistance," Vaccine, 26(45):5675-5678, Elsevier Science, Netherlands (Oct. 2008).
Eeckhaut, V., et al., "The Anaerobic Butyrate-producing Strain Butyricicoccus Pullicaecorum Decreases Colonic Inflammation and Ulceration in a Tnbs-induced Colitis Rat Model," 5th Probiotics, Prebiotics and New Foods Congress, 2009,1 page.
Eiseman, B., et al., "Fecal Enema as an Adjunct in the Treatment of Pseudomembranous Enterocolitis," Surgery, 44(5):854-859, St. Louis, MO : Mosby, United States (Nov. 1958).
Elhage, R. et al., "Emerging Trends in "Smart Probiotics": Functional Consideration for the Development of Novel Health and Industrial Applications," Frontiers in Microbiology, Sep. 2017, pp. 1-11, vol. 8, Article 1889.
El-Houssieny, R., et al., "Recovery and Detection of Microbial Contaminants in Some Non-Sterile Pharmaceutical Products," Archives of Clinical Microbiology, 4(6):1-14, Ain Shams University, Egypt (2013).
Elving, J., et al., "Composting for Avian Influenza Virus Elimination," Applied and Environmental Microbiology, 78(9):3280-3285, American Society for Microbiology, United States (May 2012).
Emanuelsson, F., et al., "Faecal Microbiota Transplantation and Bacteriotherapy for Recurrent Clostridium Difficile Infection: A Retrospective Evaluation of 31 Patients," Scandinavian Journal of Infectious Diseases, 46(2):89-97, Informa Healthcare, England (Feb. 2014).
Endt, K., et al., "The Microbiota Mediates Pathogen Clearance From the Gut Lumen After Non-Typhoidal *Salmonella* Diarrhea," PLoS Pathogens, 6(9):el001097, Public Library of Science, United States (Sep. 2010).
Eriguchi et al., "Graft versus-host disease disrupts intestinal microbial ecology by inhibiting Paneth cell production of a-defensins," Blood 120(1):223-231 (2012).
European Examination Report for EP Application No. EP 11728077.6, dated Sep. 18, 2015, 4 pages.
European Examination Report for EP Application No. EP 13856249.1, dated May 23, 2018, 6 pages.
European Examination Report for EP Application No. EP 14745749.3, dated Oct. 31, 2017, 3 pages.
European Examination Report for EP Application No. EP 14745792.3, dated Dec. 21, 2017, 6 pages.
European Examination Report for EP Application No. EP 14746341.8 , dated Jun. 13, 2017, 11 pages.
European Examination Report for EP Application No. EP 14746341.8, dated Apr. 18, 2018, 7 pages.
European Examination Report for EP Application No. EP 14746455.6, dated Oct. 31, 2017, 6 pages.
European Examination Report for EP Application No. EP 14763266.5, dated Nov. 13, 2017, 4 pages.
European Examination Report for EP Application No. EP 14768281.9 dated Dec. 18, 2017, 4 pages.
European Examination Report for EP Application No. EP 14821918.1, dated Jan. 29, 2018, 4 pages.
European Extended Search Report, EP Application No. EP 14746455.6, dated Nov. 24, 2016, 9 pages.
European Extended Search Report for EP Application No. EP 13856249.1, dated Jan. 26, 2017, 22 pages.
European Extended Search Report for EP Application No. EP 14745749.3, dated Jan. 23, 2017, 13 pages.
European Extended Search Report for EP Application No. EP 14745792.3, dated Dec. 23, 2016, 17 pages.
European Extended Search Report for EP Application No. EP 14746341.8, dated Sep. 28, 2016, 9 pages.
European Extended Search Report for EP Application No. EP 14763266.5, dated Aug. 16, 2016, 7 pages.
European Extended Search Report for EP Application No. EP 14768281.9, dated Jul. 18, 2016, 9 pages.
European Extended Search Report for EP Application No. EP 14870947.0, dated Oct. 17, 2017, 11 pages.
European Partial Supplementary Report for EP Application No. EP 14745749.3, dated Oct. 14, 2016, 6 pages.
European Partial Supplementary Report for EP Application No. EP 14745792.3, dated Sep. 20, 2016, 10 pages.
European Partial Supplementary Search Report for EP Application No. EP 14870947.0, dated Jul. 11, 2017,13 pages.
European Summons to Attend Oral Proceedings Pursuant to Rule 115(1) EPC for EP Application No. EP 14768281.9, mailed on Jul. 11, 2018, 10 pages.

(56) References Cited

OTHER PUBLICATIONS

Evelien Wynendaele et al., "Crosstalk between the microbiome and cancer cells by quorum sensing peptides", Elsevier Peptides 65 (2015) 40-48.
Everard, A., et al., "Cross-talk Between Akkermansia Muciniphila and Intestinal Epithelium Controls Diet-Induced Obesity," Proceedings of the National Academy of Sciences of the United States of America, 110(22):9066-9071, National Academy of Sciences, United States (May 2013).
Evidence of Effects of Probiotics Against Antimicrobial-Related Diarrhea, Pharmacy, Paper, 12 pages, (2011).
Ezaki, T., et al., "16s Ribosomal Dna Sequences of Anaerobic Cocci and Proposal of *Ruminococcus hansenii* Comb. Nov. And *Ruminococcus productus* Comb. Nov," International Journal of Systematic Bacteriology 44(1):130-136, Society for General Microbiology, England (Jan. 1994).
Fairhead, H., et al., "Small, Acid-soluble Proteins Bound to DNA Protect Bacillus Subtilis Spores From Being Killed by Freeze-Drying.," Applied and Environmental Microbiology, 60(7):2647-2649, American Society for Microbiology, United States (Jul. 1994).
Faith, J.J., et al., "Identifying Gut Microbe-host Phenotype Relationships Using Combinatorial Communities in Gnotobiotic Mice," Science Translational Medicine, 6(220):220ra11, American Association for the Advancement of Science, United States (Jan. 2014).
Fakhry, S., et al., "Characterization of Spore Forming Bacilli Isolated From the Human Gastrointestinal Tract," Journal of Applied Microbiology, 105(6):2178-2186, Blackwell Science, England (Dec. 2008).
Farache, J., et al., "Luminal Bacteria Recruit Cd103+ Dendritic Cells Into the Intestinal Epithelium to Sample Bacterial Antigens for Presentation," Immunity, 38(3):581-595, Cell Press, United States, (Mar. 2013).
Faust, et al., "Microbial Co-occurrence Relationships in the Human Microbiome," Plos Computational Biology, 8(7):e1002606, Public Library of Science, United States (Jul. 2012).
Fell Jr., N.F., et al., "Mitigating Phosphate Interference in Bacterial Endospore Detection by Tb Dipicolinate Photoluminescence," Analytica Chimica Acta, 426(11):43-50, Elsevier (Jan. 2001).
Ferreira, R.B., et al., "The Intestinal Microbiota Plays a Role in *Salmonella*-induced Colitis Independent of Pathogen Colonization," Plos One, 6(5):e20338, Public Library of Science, United States, (May 2011).
Fichtel, J., et al., "Spore Dipicolinic Acid Contents Used for Estimating the Number of Endospores in Sediments," FEMS Microbiology Ecology, 61(3):522-532, Elsevier Science Publishers on behalf of the Federation of European Microbiological Societies, England (Sep. 2007).
Final Office Action dated Nov. 1, 2019, in U.S. Appl. No. 16/054,864, Gregory McKenzie et al., filed Aug. 3, 2018, 10 pages.
Final Office Action dated Dec. 7, 2017, in U.S. Appl. No. 14/765,812, Afeyan, N.B., et al., filed Aug. 4, 2015.
Final Office Action dated Jan. 8, 2018, in U.S. Appl. No. 14/765,810, Maltzahn, G.V., et al., filed Aug. 4, 2015.
Final Office Action dated May 11, 2017, in U.S. Appl. No. 14/777,252, Henn, M.R., et al., filed Sep. 15, 2015.
Final Office Action dated Jan. 25, 2018, in U.S. Appl. No. 14/765,810, Maltzahn, G.V., et al., filed Aug. 4, 2015.
Final Office Action dated Apr. 14, 2020, in U.S. Appl. No. 16/223,008, Henn, M.R. et al., filed Dec. 17, 2018, 11 pages.
Final Office action dated Dec. 11, 2019, in U.S. Appl. No. 14/765,812, Afey An; N. et al., filed Aug. 4, 2015, 10 pages.
Final Office action dated Jan. 18, 2019, in U.S. Appl. No. 14/765,814, Cook; D. et al., filed Aug. 4, 2015, 14 pages.
Final Office Action dated Jul. 29, 2020, in U.S. Appl. No. 15/778,095, Button, J. et al., filed May 22, 2018, 40 pages.
Final Office Action dated Jun. 12, 2018, in U.S. Appl. No. 15/039,007, 9 pages.
Final Office Action dated Jun. 22, 2018, in U.S. Appl. No. 14/776,676, , 15 pages.
Final Office Action dated May 5, 2020, in U.S. Appl. No. 14/765,814, Cook, D. et al., filed Aug. 4, 2015, 16 pages.
Fischbach, M.A., et al., "Cell-based Therapeutics: The Next Pillar of Medicine," Science Translational Medicine, 5(179):179ps7, American Association for the Advancement of Science, United States (Apr. 2013).
Fitzpatrick, L.R., "Probiotics for the treatment of Clostridium difficile associated disease", World Journal of Gastrointestinal Pathophysiology, 4(3): 47-52, Baishideng Publishing Group, United States (Aug. 2013).
Foditsch, C., et al., "Isolation and Characterization of Faecalibacterium prausnitzii from Calves and Piglets," PLoS One, 9(12):e116465, Public Library of Science, United States (Dec. 31, 2014).
Fonseca, F., et al., "Operating Conditions That Affect the Resistance of Lactic Acid Bacteria to Freezing and Frozen Storage," Cryobiology, 43(3):189-198, Elsevier, Netherlands (Nov. 2001).
Frank, D.N., et al., "Molecular-phylogenetic Characterization of Microbial Community Imbalances in Human Inflammatory Bowel Diseases," Proceedings of the National Academy of Sciences of the United States of America 104(34):13780-13785, National Academy of Sciences, United States (Aug. 2007).
Franz, C.M.A.P., et al., "Enterococci as Probiotics and Their Implications in Food Safety," International Journal of Food Microbiology, 151(2):125-140, Elsevier Science Publishers, Netherlands (Dec. 2011).
Freifeld et al., "Clinical Practice Guideline for the Use of Antimicrobial Agents in Neutropenic Patients with Cancer: 2010 Update by the Infectious Diseases Society of America," Clinical Infectious Diseases 52(4):e56-e93 (2011).
Friedman-Moraco, R.J., et al., "Fecal Microbiota Transplantation for Refractory Clostridium Difficile Colitis in Solid Organ Transplant Recipients.," American Journal of Transplantation, 14(2):477-480, Wiley-Blackwell on behalf of the American Society of Transplant Surgeons and the American Society of Transplantation, United States (Feb. 2014).
Furusawa, Y., et al., "Commensal Microbe-derived Butyrate Induces the Differentiation of Colonic Regulatory T Cells ," Nature 504(7480):446-450, Nature Publishing Group, England (Dec. 2013).
Gaboriau-Routhiau, V., et al., "The Key Role of Segmented Filamentous Bacteria in the Coordinated Maturation of Gut Helper T Cell Responses," Immunity 31(4):677-689, Cell Press, United States (Oct. 2009).
Gallo, R.L and Hooper, L.V, "Epithelial Antimicrobial Defence of the Skin and Intestine," Nature Reviews Immunology , 12(7):503-516, Nature Publishing Group, England, (Jun. 2012).
Ganesh et al., "Commensal Akkermansia muciniphila Exacerbates Gut Inflammation in *Salmonella typhimurium*-Infected Gnotobiotic Mice," PLoS One 8(9):e74963 (2013).
GenBank: AccessionNo. NR 118589.1, accessed on Jun. 20, 2020.
GenBank HQ819637, "Uncultured Organism Clone ELU0180-T56-SNIPCRAMgANa_ 000311 Small Subunit Ribosomal RNA Gene, Partial Sequence," Jul. 30, 2012, 1 page, [Online] [Retrieved on Aug. 21, 2014] Retrieved from the Internet (URL:http://www.ncbi.nlm.nih.gov/nuccore/HQ819637).
Gennaro, A.R., Editor "Remington's Pharmaceutical Sciences", 18th Edition, Mack Publishing Co., 5 pages, 1990 (Table of Contents).
Geuking, M.B., et al., "Intestinal Bacterial Colonization Induces Mutualistic Regulatory T Cell Responses," Immunity 34(5):794-806, Cell Press, United States (May 2011).
Gevers, D., et al., "The Treatment-naive Microbiome in New-Onset Crohn's Disease," Cell Host & Microbe, 15(3):382-392, Cell Press, United States (Mar. 2014).
Giel, J.L., et al., "Metabolism of Bile Salts in Mice Influences Spore Germination in Clostridium Difficile," Plos One, 5(1):e8740, Public Library of Science, United States, (Jan. 2010).
Gilligan, P.H. (2013). Identification of Pathogens by Classical Clinical Tests. In The Prokaryotes, E. Rosenberg, E.F. Delong, S. Lory, E. Stackebrandt, and F. Thompson, eds. (Springer Berlin Heidelberg), pp. 57-89.
Goldberg et al., "T Cell-Depleted Stem Cell Transplantation for Adults with High-Risk Acute Lymphoblastic Leukemia: Long-Term

(56) References Cited

OTHER PUBLICATIONS

Survival for Patients in First Complete Remission with a Decreased Risk of Graft-versus-Host Disease," Biol. Blood Marrow Transplant 19:208-213 (2013).

Goldspiel, B.R., et al., "Human Gene Therapy," Clinical Pharmacy 12(7):488-505, American Society Of Hospital Pharmacists, United States (1993).

Goodman, N.S., et al., "Biphasic System for Separation of Spores and Crystals of Bacillus Thuringiensis," Journal of Bacteriology, 94(2):485, American Society for Microbiology, United States (Aug. 1967).

Goodman, A.L., et al., "Extensive Personal Human Gut Microbiota Culture Collections Characterized and Manipulated in Gnotobiotic Mice," Proceedings of the National Academy of Sciences of the United States of America 108(15):6252-6257, National Academy of Sciences, United States (Apr. 2011).

Gough, E., et al., "Systematic Review of Intestinal Microbiota Transplantation (Fecal Bacteriotherapy) for Recurrent Clostridium Difficile Infection," Clinical Infectious Diseases, 53(10):994-1002, The University of Chicago Press, United States (Nov. 2011).

Gould, G.W., and Sale, A.J, "Initiation of Germination of Bacterial Spores by Hydrostatic Pressure," Journal of General Microbiology, 60(3):335-346, Society for General Microbiology, England (Mar. 1970).

Grabow, W.O., et al., "Elimination of Viruses, Phages, Bacteria and Cryptosporidium by a New Generation Aquaguard Point-of-use Water Treatment Unit," International Journal of Hygiene and Environmental Medicine, 202(5):399-410, Gustav Fischer Verlag, Germany (Sep. 1999).

Grangette et al., "Enhanced antiinflammatory capacity of a Lactobacillus plantarum mutant synthesizing modified teichoic acids," PNAS 102(29): 10321-10326 (2005).

Greenway, F., et al., "A Novel Cobiotic Containing a Prebiotic and an Antioxidant Augments the Glucose Control and Gastrointestinal Tolerability of Metformin: A Case Report," Beneficial Microbes, 5(1):29-32, Wageningen Academic Publishers, Netherlands (Mar. 2014).

Grehan, M.J., et al., "Durable Alteration of the Colonic Microbiota by the Administration of Donor Fecal Flora," Journal of Clinical Gastroenterology 44(8):551-561, Wolters Kluwer Health, Inc, United States (Sep. 2010).

Grimoud, J., et al., "In Vitro Screening of Probiotic Lactic Acid Bacteria and Prebiotic Glucooligosaccharides to Select Effective Synbiotics," Anaerobe, 16(5):493-500, Academic Press, England (Oct. 2010).

Gupta, R.K., et al., "Differentiation Between Heat Resistance and Octyl Alcohol Resistance of the Cells of Bacillus Cereus T," Biochemical and Biophysical Research Communications, 38(1):23-30, Elsevier, United States (Jan. 1970).

Gut definition. Merriam Webster Dictionary. https://www.merriamwebster.com/dictionary/gut, retrieved Mar. 9, 2020.

Hahn et al., "Risk factors for Acute Graft-Versus-Host Disease after Human Leukocyte Antigen-Identical Sibling Transplants for Adults With Leukemia," J Clin. Oncol. 26(35):5728-5734 (2008).

Hall, B.G., et al., "Building Phylogenetic Trees From Molecular Data With Mega," Molecular biology and Evolution, 30(5):1229-1235, Oxford University Press, United States, (May 2013).

Halmann, M., et al., "Stages in Germination of Spores of Bacillus Licheniformis," Journal of Bacteriology, 84(6):1187-1193, American Society for Microbiology, United States (Dec. 1962).

Hamil ton, M.J., et al., "Standardized Frozen Preparation for Transplantation of Fecal Microbiota for Recurrent Clostridium Difficile Infection," The American Journal of Gastroenterology, 107(5):761-767, Wolters Kluwer Health, United States (May 2012).

Hamilton, M. J., et al., "High-throughput Dna Sequence Analysis Reveals Stable Engraftment of Gut Microbiota Following Transplantation of Previously Frozen Fecal Bacteria," Gut Microbes, 4(2):125-135, Philadelphia, United States, (Mar.-Apr. 2013).

Hand, T.W., et al., "Acute Gastrointestinal Infection Induces Long-lived Microbiota-specific T Cell Responses," Science, 337(6101):1553-1556, American Association for the Advancement of Science, United States, (Sep. 2012).

Hansen, A.K. et al., "Handbook of Laboratory Animal Bacteriology," Second Edition, CRC Press, 2015, p. 158 (3 total pages).

Harmsen, H. J. M., et al., "Comparison of Viable Cell Counts and Fluorescence in Situ Hybridization Using Specific rRNA-based Probes for the Quantification of Human Fecal Bacteria," FEMS Microbiology Letters, 183(1):125-129, Oxford Oxford University Press, England (Feb. 2000).

Harrison, F, "Bacterial Cooperation in the Wild and in the Clinic: Are Pathogen Social Behaviours Relevant Outside the Laboratory?," BioEssays , 35(2):108-112, Wiley, United States (Feb. 2013).

Hasan, J.A., et al., "In Vitro Production of Clostridium Difficile Spores for Use in the Efficacy Evaluation of Disinfectants: a Precollaborative Investigation," Journal of AOAC International, 94(1):259-272, Aoac International, United States (Jan. 2011).

Hata, D.J. et al., "Blood Group B Degrading Activity of Ruminococcus Gnavus Alpha-Galactosidase," Artif. Cells Blood Substit. lmmobil. Biotechnol., May 2004, pp. 263-274, vol. 32, No. 2.

Hayashi, H., et al., "Phylogenetic Analysis of the Human Gut Microbiota Using 16s Rdna Clone Libraries and Strictly Anaerobic Culture-based Methods," Microbiology and Immunology 46(8):535-548, Wiley-Blackwell, Australia (2002).

Hayashi, Y., et al., "Western Blot (Immunoblot) Assay of Small, Round-structured Virus Associated With an Acute Gastroenteritis Outbreak in Tokyo," Journal of Clinical Microbiology, 27(8):1728-1733, American Society for Microbiology, United States (Aug. 1989).

Hazenberg, M.P., et al., "Conversion of Germ-free Mice to the Normal State by Clostridia," Zeitschrift für Versuchstierkunde 18(4):185-190, Gustav Fischer Verlag, Germany (1976).

Heeg, D et al., "Spores of Clostridium dif.ficile Clinical Isolates Display a Diverse Germination Response to Bile Salts," PLoS One 7(2):e32381 (2012).

Hell, M., et al., "Probiotics in Clostridium Difficile Infection: Reviewing the Need for a Multistrain Probiotic," Beneficial Microbes, 4(1):39-51, Wageningen Academic Publishers, Netherlands (Mar. 2013).

Hemmerling, A., et al., "Phase 2a Study Assessing Colonization Efficiency, Safety, and Acceptability of Lactobacillus crispatus CTV-05 in Women With Bacterial Vaginosis," Sexually Transmitted Diseases, 37(12):745-750 (Dec. 2010).

Herron, P.R., and Wellington, E.M.H, "New Method for Extraction of Streptomycete Spores From Soil and Application to the Study of Lysogeny in Sterile Amended and Nonsterile Soil," Applied and Environmental Microbiology, 56(5):1406-1412, American Society for Microbiology, United States (May 1990).

Hewitt, J., et al., "Evaluation of Murine Norovirus as a Surrogate for Human Norovirus and Hepatitis a Virus in Heat Inactivation Studies," Journal of Applied Microbiology, 107(1):65-71, Oxford : Published for the Society for Applied Bacteriology by Blackwell Science, England (Jul. 2009).

Hickson, M., "Probiotics in the Prevention of Antibiotic-associated Diarrhoea and Clostridium Difficile Infection," Therapeutic Advances in Gastroenterology, 4(3):185-197, Sage Publications, England (May 2011).

Hiemenz, "Management of Infections Complicating Allogeneic Hematopoietic Stem Cell Transplantation," Semin Hematol 46:289-312 (2009).

Hill, D.A., et al., "Commensal bacteria-derived signals regulate basophil hematopoiesis and allergic inflammation," Nat Med., 18(4):538-546 (2012).

Hindle, A.A., and Hall, E.A.H, "Dipicolinic Acid (DPA) Assay Revisited and Appraised for Spore Detection," The Analyst, 124(11): 1599-1604 (1999).

Hirsch, E.B., and Tam, V.H, "Detection and Treatment Options for Klebsiella Pneumoniae Carbapenemases (KPCS): an Emerging Cause of Multidrug-Resistant Infection," The Journal of Antimicrobial Chemotherapy, 65(6):1119-1125, Oxford University Press, England (Jun. 2010).

(56) References Cited

OTHER PUBLICATIONS

Hofsten, B.V., "Partition of *Escherichia coli* in an Aqueous Polymer Two-phase System," Experimental Cell Research, 41(1):117-123 (Jan. 1966).

Holdeman, L,V., et al., "Human Fecal Flora: Variation in Bacterial Composition Within Individuals and a Possible Effect of Emotional Stress," Applied and Environmental Microbiology 31(3):359-375, American Society for Microbiology, United States (Mar. 1976).

Holler et al., "Metagenomic Analysis of the Stool Microbiome in Patients Receiving Allogeneic Stem Cell Transplantation: Loss of Diversity Is Associated with Use of Systemic Antibiotics and More Pronounced m Gastrointestinal Graft-versus-Host Disease," Biol. Blood Marrow Transplant. 20:640-645 (2014).

Holmes, E., et al., "Therapeutic Modulation of Microbiota-Host Metabolic Interactions," Science Translational Medicine, 4(137):137rv6, American Association for the Advancement of Science, United States (Jun. 2012).

Holt G. J., et al., "Bergey's Manual of Determinative Bacteriology," Ninth Edition, 1994, pp. 527, 531, 577, 579 (6 pages total).

Honda, K., et al., "Regulations of T cell reponses by intestinal commensal bacteria," Journal of Intestinal Microbiology 25(2):103-104, (Apr. 2011).

Hong et al., "1H NMR-based Metabonomic Assessment of Probiotic Effects in a Colitis Mouse Model," Arch Pharm Res 33(7): 1091-1101 (2010).

Hong, H.A., et al., "The Use of Bacterial Spore Formers as Probiotics," FEMS Microbiology Reviews 29(4):813-835, Oxford University Press, England (Sep. 2005).

Hoppe, B., et al., "Efficacy and Safety of Oxalobacter Formigenes to Reduce Urinary Oxalate in Primary Hyperoxaluria," Nephrology, Dialysis, Transplantation, 26(11):3609-3615, Oxford University Press, England (Nov. 2011).

Hoyles, L., et al., "Recognition of Greater Diversity of *Bacillus* Species and Related Bacteria in Human Faeces," Research in Microbiology, 163(1):3-13, Elsevier, France (Jan. 2012).

Hue et al., "Interleukin-23 drives innate and T cell-mediated intestinal inflammation," JEM 203(11):2473-2483 (2006).

Human Microbiome Project Consortium, "Structure, Function and Diversity of the Healthy Human Microbiome," Nature, 486(7402):207-214, Nature Publishing Group, England (Jun. 2012).

Hurst, C.J., and Gerba, C.P, "Fate of Viruses During Wastewater Sludge Treatment Processes," Critical Reviews in Environmental Control, 18(4):317-343 (Jan. 2009).

Huse, S.M., et al., "Exploring Microbial Diversity and Taxonomy Using SSU rRNA Hypervariable Tag Sequencing," PLoS Genetics 4(11):el000255, Public Library of Science, United States (Nov. 2008).

ICI Wrap-up Report Immunology in the 21st Century: Defeating Infection, Autoimmunity, Allergy and Cancer, 14th International Congress of Immunology, Aug. 22-27, 2010, Japan, 1 page.

International Search Report and Patentability for Application No. PCT/US2016/063697, dated May 29, 2018, Button et al., "Designed Bacterial Compositions," filed Nov. 23, 2016, 27 pages.

International Search Report and Written Opinion for Application No. PCT/US2016/041538, dated Sep. 23, 2016, Cook., et al., "Methods of Treating Colitis," filed Jul. 8, 2016, 12 Pages.

International Search Report and Written Opinion for International Application No. PCT/US13/71758, Alexandria, Virginia, dated May 5, 2014, 37 pages.

International Search Report and Written Opinion for International Application No. PCT/US14/14738, Alexandria, Virginia, dated Jul. 30, 2014, 26 pages.

International Search Report and Written Opinion for International Application No. PCT/US14/14744, Alexandria, Virginia, dated May 21, 2014, 26 pages.

International Search Report and Written Opinion for International Application No. PCT/US14/14745, Alexandria, Virginia, dated Jul. 30, 2014, 25 pages.

International Search Report and Written Opinion for International Application No. PCT/US14/14747, Alexandria, Virginia, dated Jun. 13, 2014, 17 pages.

International Search Report and Written Opinion for International Application No. PCT/US14/70684, Alexandria, Virginia, dated Jun. 10, 2015, 11 pages.

International Search Report and Written Opinion for International Application No. PCT/US2014/029539, Alexandria, Virginia, dated Oct. 10, 2014, 12 pages.

International Search Report and Written Opinion for International Application No. PCT/US2014/030817, Alexandria, Virginia, dated Dec. 5, 2014, 15 pages.

International Search Report and Written Opinion for International Application No. PCT/US2014/067491, European Patent Office, H V Rijswijk, dated Apr. 2, 2015, 12 pages.

International Search Report and Written Opinion for International Application No. PCT/US2016/063697, European Patent Office, H V Rijswijk, dated May 19, 2017, 24 pages.

International Search Report and Written Opinion for International Application No. PCT/US2019/025010, European Patent Office, Netherlands, dated Jul. 11, 2019.

International Search Report dated Apr. 14, 2016 in International Application No. PCT/US2015/062734.

International Search Report for International Application No. PCT/US2015/31627, ISA/US, Commissioner for Patents, Alexandria, Virginia, dated Sep. 8, 2015.

International Statistical Classification of Diseases and Related Health Problems 1 O'h Review, Chapter 1: Certain Infectious and Parasitic Diseases (AOO-B99), 2016, 2 pages.

Israel Office Action, Israel Application No. 238973, dated Apr. 20, 2017, 4 pages (with concise explanation of relevance).

Itoh, K., et al., "Characterization of Clostridia Isolated From Faeces of Limited Flora Mice and Their Effect on Caecal Size When Associated With Germ-Free Mice," Laboratory Animals 19(2):111-118, Sage, England (Apr. 1985 ).

Itoh, K., et al., "Colonization Resistance Against Pseudomonas Aeruginosa in Gnotobiotic Mice," Laboratory Animals 20(3):197-201, Laboratory Animals Ltd, England (Jul. 1986).

Itoh, K., et al., "Intestinal Bacteria Antagonistic to Clostridium Difficile in Mice," Laboratory Animals 21(1):20-25, Laboratory Animals Ltd, England (Jan. 1987).

Ivanov, I.I., et al., "Induction of intestinal Th 17 cells by segmented filamentous bacteria," Cell, 139(3):485-498 (2009).

Ivanov, I.I., et al., "Specific Microbiota Direct the Differentiation of Il-17-Producing T-Helper Cells in the Mucosa of the Small Intestine," Cell Host Microbe 4(4):337-349, Cell Press, United States (Oct. 2008) including supplemental data.

Jacobs et al., "1H NMR metabolite profiling of feces as a tool to assess the impact of nutrition on the human microbiome," NMR in Biomedicine 21:615-626 (2008).

Jaffe et al., "Prevention of Peritransplantation Viridans Streptococcal Bacteremia with Early Vancomycin Administration: A Single-Center Observational Cohort Study," Clin Infect Dis. 39:1625-1632 (2004).

Jagasia et al., "Risk factors for acute GVHD and survival after hematopoietic cell transplantation," Blood 119(1):296-307 (2012).

Jakubowski et al., "T Cell-Depleted Unrelated Donor Stem Cell Transplantation Provides Favorable Disease-Free Survival for Adults with Hematologic Malignancies," Biol. Blood Marrow Transplant 17:1335-1342 (2011).

Jalanka-Tuovinen, J., Salojarvi, J., Salonen, A., Immonen, 0., Garsed, K., Kelly, F.M., Zaitoun, A., Palva, A., Spiller, R.C., and Devos, W.M. (2013). Faecal microbiota composition and host-microbe cross-talk following gastroenteritis and in postinfective irritable bowel syndrome. Gut 0, 1-9.

Janda, J.M., et al.," 16S rRNA Gene Sequencing for Bacterial Identification in the Diagnostic Laboratory: Pluses, Perils, and Pitfalls," Journal of Clinical Microbiology, 45(9):2761-2764, American Society for Microbiology, United States (Sep. 2007).

Janeway, C.A. et al., "Autoimmune Responses are Directed Against Self Antigens," lmmunobiology: The Immune System in Health and Disease, 51th Edition, Garland Science, 2001, pp. 1-14.

(56) References Cited

OTHER PUBLICATIONS

Janeway, C.A. et al., Immuno Biology, 61th Edition, Garland Science Publishing, 2005, p. 414.
Japanese First Office Action, Japanese Application No. 2015-544179, dated Sep. 19, 2017, 8 pages.
Japanese Office Action, Japanese Application No. 2015-556240, dated Jun. 5, 2018, 5 pages.
Japanese Office Action, Japanese Application No. 2015-556240, dated Oct. 3, 2017, 8 pages.
Japanese Office Action, Japanese Application No. 2015-556241, dated Sep. 26, 2017, 12 pages.
Japanese Office Action, Japanese Application No. JP2016-502561, dated Feb. 6, 2018, 10 pages.
Jarry, A., et al., "Mucosal IL-10 and TGF-Beta Play Crucial Roles in Preventing LPS-driven, IFN-gamma-mediated Epithelial Damage in Human Colon Explants," The Journal of Clinical Investigation, 118(3):1132-1142, American Society for Clinical Investigation, United States (Mar. 2008).
Jawetz, et al., "Chapter 11: Spore-Forming Gram-Positive Bacilli: *Bacillus* and *Clostridium* Species," Jawetz, Melnick&Adelberg's Medical Microbiology, 26e:1-15 (Mar. 7, 2017).
Jeffs, L.B., and Khachatourians, G.G, "Estimation of Spore Hydrophobicity for Members of the Genera *Beauveria, Metarhizium,* and *Tolypocladium* by Salt-mediated Aggregation and Sedimentation," Canadian Journal of Microbiology, 43(1):23-28 (1997).
Jenq et al., "Intestinal Blautia Is Associated with Reduced Death from Graft-versus-Host Disease," Biology ofBlood and Marrow Transplantation 21:1373-1383 (2015).
Jenq et al., "Regulation of intestinal inflammation by microbiota following allogeneic bone marrow transplantation," J Exp. Med. 209(5):903-911 (2012).
Jensen, N.S., and Canale-Parola, E, "*Bacteroides pectinophilus* Sp. Nov. And *Bacteroides galacturonicus* Sp. Nov.: Two Pectinolytic Bacteria From the Human Intestinal Tract.," Applied and Environmental Microbiology, 52(4):880-887, American Society for Microbiology, United States (Oct. 1986).
Johansson et al., "The two mucus layers of colon are organized by the MUC2 mucin, whereas the outer layer is a legislator of host-microbial interactions," PNAS 108(Suppl. 1):4659-4665 (2011).
Johnson, S., et al., "Is Primary Prevention of Clostridium Difficile Infection Possible With Specific Probiotics?," International Journal of Infectious Diseases, 16(11):e786-e792, Elsevier, Canada (Nov. 2012).
Johnston, R., et al., "Method To Facilitate the Isolation of Clostridium Botulinum Type E," Journal of Bacteriology, 88(5):1521-1522, American Society for Microbiology, United States (Nov. 1964).

Jones et al., "Mortality and Gross Pathology of Secondary Disease in Germfree Mouse Radiation Chimeras," Radial Res. 45(3)577-588 (1971).

Jones, M.L., et al., "Cholesterol Lowering and Inhibition of Sterol Absorption by Lactobacillus Reuteri NCIMB 30242: a Randomized Controlled Trial," European Journal of Clinical Nutrition, 66(11):1234-1241, Nature Publishing Group, England (Nov. 2012).

Jones, M.L., et al., "Cholesterol-lowering Efficacy of a Microencapsulated Bile Salt Hydrolase-active Lactobacillus Reuteri Ncimb 30242 Yoghurt Formulation in Hypercholesterolaemic Adults.," The British Journal of Nutrition, 107(10):1505-1513, Wallingford, England (May 2012).

Joosten, H., et al., "*Salmonella* Detection in Probiotic Products," International Journal of Food Microbiology, 110(1):104-107, Elsevier Science Publishers, Netherlands (Jul. 2006).

Jordan, F., et al., "Network Ecology: Topological Constraints on Ecosystem Dynamics," Physics of Life Reviews, 1(3): 139-172, (Dec. 2004).

Jorgensen, J.H., and Ferraro, M.J, "Antimicrobial Susceptibility Testing: a Review of General Principles and Contemporary Practices," Clinical Infectious Diseases, 49(11):1749-1755, Oxford University Press,United States (Dec. 2009).

Jorup-Ronstrom, C., et al., "Fecal Transplant Against Relapsing Clostridium Difficile-associated Diarrhea in 32 Patients," Scandinavian Journal of Gastroenterology, 47(5):548-552, Informa Healthcare, England (May 2012).

Jousimies-Somer, General Considerations, Preliminary Identification Methods, Advanced Identification Methods, Chapter 4, 2002, pp. 55-185.

Jousimies-Somer, H., Summanen, P., Citron, D.M., Baron, E.J., Wexler, H.M., and Finegold, S.M. (2002). Wadsworth-KLT Anaerobic Bacteriology Manual, 6th edition (California: Star), pp. 55-74, 81-132, 165-185.

Kabeerdoss, J., et al., "Clostridium Leptum Group Bacteria Abundance and Diversity in the Fecal Microbiota of Patients With Inflammatory Bowel Disease: A Case-control Study in India," BMC Gastroenterology 13:20, BioMed Central, England (Jan. 2013).

Kailasapathy, K., "Microencapsulation of Probiotic Bacteria: Technology and Potential Applications," Current Issues in Intestinal Microbiology, 3(2):3 9-48, Horizon Scientific Press, England (Sep. 2002).

Kakihana, K., et al., "Fecal Microbiota Transplantation for Patients with Steroid-Resistant Acute Graft-Versus-Host Disease of the Gut," Blood 128(16):2083-2088, American Society of Hematology, United States (Oct. 2016).

Kamboj et al., "Clostridium difficile Infection after Allogeneic Hematopoietic Stem Cell Transplant: Strain Diversity and Outcomes Associated with NAP1/027," Biol. Blood Marrow Transplant 20:1626-1633 (2014).

Kamboj et al., "The Changing Epidemiology of Vancomycin-Resistant Enterococcus (VRE) Bacteremia m Allogeneic Hematopoietic Stem Cell Transplant (HSCT) Recipients," Biol Blood Marrow Transplant 16:1576-1581 (2010).

Kamiya, S., et al., "Recovery of Spores of Clostridium Difficile Altered by Heat or Alkali," Journal of Medical Microbiology, 28(3):217-221, Microbiology Society, England (Mar. 1989).

Kanamoto, T. et al., "Genetic Heterogeneities and Phenotypic Characteristics of Strains of The Genus *Abiotrophia* and Proposal of *Abiotrophia para-adiacens*sp. nov.," Journal of Clinical Microbiology, Feb. 2000, pp. 492-498, vol. 38, No. 2; Abiotropia para-adjacens gene for 16S rRNA, partial sequence, strain: Nucleotide: NCBI: GenBank: AB022027.1, last accessed Mar. 12, 2014, p. 8.

Kanehisa Laboratories. KEGG: Kyoto encyclopedia of genes and genomes. (http://www.genome.jp/kegg/); Accessed Mar. 27, 2014.

Kang, D.J., et al., "Clostridium scindens baiCD and baiH genes encode stereo-specific 7a/7~-hydroxy-3-oxo-114-cholenoic acid oxidoreductases," Biochim Biophys Acta 1781(1-2): 16-25 (2008).

Karasawa, T., et al., "A Defined Growth Medium for Clostridium Difficile," Microbiology, 141 (2):371-375, Kluwer Academic/Plenum Publishers, United States (Feb. 1995).

Kazamias, M. and Sperry, J, "Enhanced Fermentation of Mannitol and Release of Cytotoxin by Clostridium Difficile in Alkaline Culture Media," Applied and Environmental Microbiology, 61(6):2425-2427, American Society for Microbiology, United States (Jun. 1995).

Kelly, D., et al., "Commensal Anaerobic Gut Bacteria Attenuate Inflammation by Regulating Nuclear-cytoplasmic Shuttling of PPAR-gamma and Rela," Nature Immunology, 5(1):104-112, Nature America Incorporated, United States (Jan. 2004).

Kelly, D., et al., "Commensal Gut Bacteria: Mechanisms of Immune Modulation," Trends in Immunology 26(6):326-333, Elsevier Science Ltd, England (Jun. 2005).

Keynan, Y., et al., "The Role of Regulatory T Cells in Chronic and Acute Viral Infections," Clinical Infectious Diseases 46(7) 1046-1052, Oxford University Press, United states (Apr. 2008).

Khoruts, A. (2013). How Does Fecal Microbiota Transplantation Treat Clostridium difficile Infection? (https://www.genome.gov/Multimedia/Siides/HumanMicrobiomeScience2013/39_Khor uts.pdf) Accessed Mar. 21, 2014.

Khoruts, A., and Sadowsky, M.J, "Therapeutic Transplantation of the Distal Gut Microbiota," Mucosal Immunology, 4(1):4-7, Nature Publishing Group, United States (Jan. 2011).

Khoruts, A., et al., "Changes in the Composition of the Human Fecal Microbiome After Bacteriotherapy for Recurrent Clostridium Difficile-

(56) References Cited

OTHER PUBLICATIONS associated Diarrhea," Journal of Clinical Gastroenterology 44(5):354-360, Wolters Kluwer Health, United states (May 2010 ).

Kim, B., et al., "Bacteraemia Due to Tribe Proteeae: a Review of 132 Cases During a Decade (1991-2000)," Scandinavian Journal of Infectious Diseases, 35(2):98-103, nforma Healthcare, England (2003).

Kim, J.Y., et al., "Effect of Oral Probiotics (Bifidobacterium Lactis AD011 and Lactobacillus Acidophilus AD031) Administration on Ovalbumin-induced Food Allergy Mouse Model," Journal of Microbiology and Biotechnology, 18(8):1393-1400, Korean Society for Microbiology and Biotechnology, Korea (Aug. 2008).

Kim, S.W., et al., "Treatment of Refractory or Recurrent Clostridium Difficile Infection," The Korean Journal of Gastroenterology = Taehan Sohwagi Hakhoe Chi, 60(2):71-78, Korean Society of Gastroenterology, [2003],Korea (South), (Aug. 2012).

Kinnebrew, M.A., et al., "Early Clostridium Difficile Infection During Allogeneic Hematopoietic Stem Cell Transplantation," Plos One, 9(3):e90158, Public Library of Science, United States, (Mar. 2014).

Kitahara, M., et al., "Assignment of *Eubacterium* sp. VPI 12708 and Related Strains with High Bile Acid 7alpha-dehydroxylating Activity to *Clostridium scindens* and Proposal of *Clostridium hylemonae* sp. nov., Isolated from Human Faeces," International Journal of Systematic and Evolutionary Microbiology 50(3):971-978, Microbiology Society, England (May 2000).

Klayraung, S., et al., "Development of Tablets Containing Probiotics: Effects of Formulation and Processing Parameters on Bacterial Viability," International Journal of Pharmaceutics, 370(1-2):54-60, Elsevier/North-Holland Biomedical Press, Netherlands (Mar. 2009).

Koeth, R.A., et al., "Intestinal Microbiota Metabolism of L-carnitine, a Nutrient in Red Meat, Promotes Atherosclerosis," Nature Medicine, 19(5):576-585, Nature Publishing Company, United States, (May 2013).

Kollmann, M., et al., "Design Principles of a Bacterial Signalling Network," Nature, 438(7067):504-507, Nature Publishing Group, England (Nov. 2005).

Kong, Q., et al., "Oral Administration of Clostridium Butyricum for Modulating Gastrointestinal Microflora in Mice," Current Microbiology, 62(2):512-517, Springer International, United States (Feb. 2011).

Konstantinidis, K.T., et al., "The Bacterial Species Definition in the Genomic Era," Philosophical Transactions of the Royal Society of London. Series B, Biological Sciences, 361(1475):1929-1940, Royal Society, England (Nov. 2006).

Koonin, E.V. (2002). Chapter 22 The clusters of orthologous groups (COGS) database: Phylogenetic classification of proteins from complete genomes. (http://www.ncbi.nlm.nih.gov/books/NBK21090/pdf/ch22.pdf) Accessed Mar. 27, 2014.

Koransky, J.R., et al., "Use of Ethanol for Selective Isolation of Sporeforming Microorganisms," Applied and Environmental Microbiology, 35(4):762-765, American Society for Microbiology, United States (Apr. 1978).

Kort, R., et al., "Assessment of Heat Resistance of Bacterial Spores from Food Product Isolates by Fluorescence Monitoring of Dipicolinic Acid Release," Applied and Environmental Microbiology, 71(7):3556-3564 (2005).

Kriegler, M., Gene Transfer and Expression, A Laboratory Manual, Stockton Press, NY (1990).

Krishna, S.G., et al., "Risk Factors, Preemptive Therapy, and Antiperistaltic Agents for Clostridium Difficile Infection in Cancer Patients," Transplant Infectious Disease, 15(5):493-501, Munksgaard, Denmark, (Oct. 2013 ).

Krogius-Kurikka, L., et al., "Sequence Analysis of Percent G+C Fraction Libraries of Human Faecal Bacterial Dna Reveals a High No. of Actinobacteria," BMC Microbiology 9:68, BioMed Central, England (Apr. 2009).

Kron et al., "Adenovirus Vectors and Subviral Particles for Protein and Peptide Delivery," Curr Gene Ther 12:362-373 (2012).

Kucerova, Z., et al., "Purification of Enterocytozoon bieneusi Spores from Stool Specimens by Gradient and Cell Sorting Techniques," Journal of Clinical Microbiology, 42(7):3256-3261 (2004).

Kumar, M., et al., "Cholesterol-lowering Probiotics as Potential Biotherapeutics for Metabolic Diseases," Experimental Diabetes Research, 2012:902917, Hindawi Publishing Corporation, United States (2012).

Kump, P.K., et al., "Alteration of Intestinal Dysbiosis by Fecal Microbiota Transplantation Does Not Induce Remission in Patients With Chronic Active Ulcerative Colitis," Inflammatory Bowel Disease, 19(10):2155-2165, Oxford University Press, England (Sep. 2013).

Kunde, S., et al., "Safety, Tolerability, and Clinical Response After Fecal Transplantation in Children and Young Adults With Ulcerative Colitis," Journal of Pediatric Gastroenterology and Nutrition, 56(6):597-601, Lippincott Williams & Wilkins, United States (Jun. 2013).

Kyne, L., et al., "Health Care Costs and Mortality Associated With Nosocomial Diarrhea Due to Clostridium Difficile," Clinical Infectious Diseases, 34(3):346-353, Oxford University Press, United States, (Feb. 2002).

Lackie, J.M. and Dow, J.A.T., "The Dictionary of Cell and Molecular Biology," 3rd Edition, Academic Press, United States (1999).

Landy, J., et al., "Review Article: Faecal Transplantation Therapy for Gastrointestinal Disease," Alimentary pharmacology & therapeutics 34(4):409-415, Wiley-Blackwell, England (Aug. 2011).

Langille, M.G., et al., "Predictive Functional Profiling of Microbial Communities Using 16s Rrna Marker Gene Sequences," Nature biotechnology, 31(9):814-821, Nature America Publishing, United States, (Sep. 2013).

Langrish et al., "IL-12 and IL-23: master regulators of innate and adaptive immunity," Immunological Reviews 202:96-105 (2004).

LaRocco et al., "Infection in the Bone Marrow Transplant Recipient and Role of the Microbiology Laboratory in Clinical Transplantation," Clinical Microbiology Reviews 1 0(2):277-297 (1997).

Lathrop, S.K., et al., "Peripheral Education of the Immune System by Colonic Commensal Microbiota," Nature, 478(7368):250-254, Nature Publishing Group, England, (Sep. 2011).

Lau, S.K.P., et al., "Bacteraemia Caused By Anaerotruncus Colihominis and Emended Description of the Species," Clinical Pathology 59(7):748-752, BMJ Pub. Group, England (Jul. 2006).

Lawley, T.D., et al., "Targeted Restoration of the Intestinal Microbiota With a Simple, Defined Bacteriotherapy Resolves Relapsing Clostridium Difficile Disease in Mice," PLoS Pathogens 8(10):e1002995, Public Library of Science, United States (Oct. 2012).

Lawson, P.A., "Anaerotruncus," Bergey's Manual of Systematics of Archaea and Bacteria, Bergey's Manual Trust, 2009, pp. 1-4.

Lawson, P.A., et al., "*Anaerotruncus colihominis* Gen. Nov., Sp. Nov., from Human Faeces," International Journal of Systematic and Evolutionary Microbiology 54(Pt 2):413-417, Microbiology Society, England (Mar. 2004).

Lee, I.K., and Liu, J.W., "Clinical Characteristics and Risk Factors for Mortality in Morganella Morganii Bacteremia," Journal of Microbiology, Immunology and Infection, 39(4):328-334, Elsevier for the Taiwan Society of Microbiology, England (Aug. 2006).

Lee, J.S., et al., "Survival of Freeze-dried Lactobacillus Bulgaricus KFRI 673 in Chitosan-coated Calcium Alginate Microparticles," Journal of Agricultural and Food Chemistry, 52(24):7300-7305, American Chemical Society, United States (Dec. 2004).

Lee, M., et al., "Synthetic Peptidoglycan Motifs for Germination of Bacterial Spores," ChemBioChem, 11(18):2525-2529, Wiley-VCH Verlag, Germany (Dec. 2010).

Lehar, J., et al., "Chemical Combination Effects Predict Connectivity in Biological Systems," Molecular Systems Biology, 3:1-14, Wiley Blackwell, England (Feb. 2007).

Lemon, K.P., et al., "Microbiota-targeted Therapies: an Ecological Perspective," Science Translational Medicine, 4(137):137rv5, American Association for the Advancement of Science, United States (Jun. 2012).

Leslie, S.B., et al., "Trehalose and Sucrose Protect Both Membranes and Proteins in Intact Bacteria During Drying," Applied and Environmental Microbiology, 61(10):3592-3597, American Society for Microbiology, United States (Oct. 1995).

(56) References Cited

OTHER PUBLICATIONS

Liggins, M., et al., "Progesterone Analogs Influence Germination of Clostridium Sordellii and Clostridium Difficile Spores in Vitro," Journal of Bacteriology, 193(11):2776-2783, American Society for Microbiology, United States (Jun. 2011).
Lindner et al., "Diversification of memory B cells drives the continuous adaptation of secretory antibodies to gut microbiota," Nature Immunology 16(8):880-890 (2015).
Lindsay, J.A., et al., "Protoplast Water Content of Bacterial Spores Determined by Buoyant Density Sedimentation," Journal of Bacteriology, 163(2):735-737, American Society for Microbiology, United States (Aug. 1985).
Liu, C., et al., "Reclassification of *Clostridium coccoides, Ruminococcus hansenii, Ruminococcus hydrogenotrophicus, Ruminococcus luti, Ruminococcus productus and Ruminococcus schinkii* as *Blautia coccoides*Gen. Nov., Comb. Nov., *Blautia hansenii* Comb. Nov., *Blautia hydrogenotrophica* Comb. Nov., *Blautia luti* Comb. Nov., *Blautia producta* Comb. Nov., *Blautia schinkii* Comb. Nov. And Description of *Blautia wexlerae* Sp. Nov., Isolated From Human Faeces," International Journal of Systematic and Evolutionary Microbiology 58(Pt 8):1896-1902, Microbiology Society, England (Aug. 2008).
Liu, K., et al., "RAxML and FastTree: Comparing Two Methods for Large-scale Maximum Likelihood Phylogeny Estimation," PloS One, 6(11):e27731, Public Library of Science, United States (2011).
Livingston, S.J., et al., "New Medium for Selection and Presumptive Identification of the Bacteroides Fragilis Group," Journal of Clinical Microbiology, 7(5):448-453, American Society for Microbiology, United States (May 1978).
Lizuka, M., et al., "Elemental Diet Modulates the Growth of Clostridium Difficile in the Gut Flora," Alimentary Pharmacology & Therapeutics, 20(1):151-157, Wiley-Blackwell, England (Jul. 2004).
Ll, A.D., et al., "Clinical Features and Bacterial Culture on Stools of Patients with Acute Diarrhea," Chinese Journal of Health Laboratory Technology, 2(6):559-561 (Mar. 2012).
Lodish, H. et al., "Viruses: Structure, Function, and Uses," Molecular Cell Biology, 41h Edition, 2000, pp. 1-12.
Loeffler, J.P., et al., "Gene Transfer Into Primary and Established Mammalian Cell Lines With Lipopolyamine-coated DNA," Methods in Enzymology 217:599-618, Academic Press, United States (1993).
Logan, N.A., "Bacillus and Relatives in Foodbome Illness," Journal of Applied Microbiology, 112(3):417-429, Published for the Society for Applied Bacteriology by Blackwell Science, England (Mar. 2012).
Lopetuso, L.R., et al., "Commensal Clostridia: Leading Players in the Maintenance of Gut Homeostasis," Gut Pathogens, 5(1):23, BioMed Central, England (Aug. 2013).
Louie, T.J., et al., "Tolevamer, a Novel Nonantibiotic Polymer, Compared With Vancomycin in the Treatment of Mild to Moderately Severe Clostridium Difficile-associated Diarrhea," Clinical Infectious Diseases, 43(4):411-420, Oxford University Press, United States, (Aug. 2006).
Louis, P and Flint, H.J., "Diversity, Metabolism and Microbial Ecology of Butyrate-producing Bacteria From the Human Large Intestine," FEMS Microbiology Letters 294(1):1-8, Oxford University Press, England (May 2009).
Lozupone, C and Knight, R., "UniFrac: a New Phylogenetic Method for Comparing Microbial Communities," Applied and Environmental Microbiology 71(12):8228-8235, American Society for Microbiology, United States (Dec. 2005).
Lozupone, C., et al., "Identifying Genomic and Metabolic Features That Can Underlie Early Successional and Opportunistic Lifestyles of Human Gut Symbionts," Genome Research, 22(10):1974-1984, Cold Spring Harbor Laboratory Press, United States (Oct. 2012).
Lozupone et al., "UniFrac-An online tool for comparing microbial community diversity in a phylogenetic context," BMC Bioinformatics 7:371 (2006).
Machine Translation of PCT Specification, PCT Application No. PCT/JP2010/071746, Filed Dec. 3, 2010, 79 pages.

MacMillan et al., "What predicts high risk acute graft-versus-host disease (GVHD) at onset?: identification of those at highest risk by a novel acute GVHD risk score," Br. J. Haematol 157:732-741 (2012).
Macpherson, A.J and Uhr, T., "Induction of Protective Iga by Intestinal Dendritic Cells Carrying Commensal Bacteria," Science, 303(5664):1662-1665, American Association for the Advancement of Science, United States, (Mar. 2004).
Magurran, "Measuring Biological Diversity," Malden, MA: Blackwell Publishing; 2004.
Maizels, R.M. and Smith, K.A., "Regulatory T Cells in Infection," Advances in Immunology 112:73-136, Academic Press, United states (2011).
Malard et al., "Impact of Cyclosporine-A Concentration on the Incidence of Severe Acute Graft-Versus-Host Disease after Allogeneic Stem Cell Transplantation," Biol. Blood Marrow Transplant 16:28-34 (2010).
Malik, K.A., "A New Freeze-drying Method for the Preservation of Nitrogen-fixing and Other Fragile Bacteria," Journal of Microbiological Methods, 8(5):259-271, Elsevier, Netherlands (Mar. 1988).
Manafi, M. Handbook of Culture Media for Food and Water Microbiology, 3rd Edition, Janet E.L. Corry et al., 2012, pp. 223-260.
Manges, A.R., et al., "Comparative Metagenomic Study of Alterations to the Intestinal Microbiota and Risk of Nosocomial Clostridum Difficile-associated Disease," The Journal of Infectious Diseases, 202(12):1877-1884, Oxford University Press, United States, (Dec. 2010).
Manichanh, C. et al., "Reshaping the Gut Microbiome with Bacterial Transplantation and Antibiotic Intake," Genome Research, 2010, pp. 1411-1419, vol. 20.
Manichanh, C., "Reduced Diversity of Faecal Microbiota in Crohn's Disease Revealed by a Metagenomic Approach," Gut, 55(2):205-211, British Medical Assn, England (Feb. 2006).
Marcus et al., "Deoxycholic acid and the pathogenesis of gall stones," Gut, 29, 522-533, BMJ Publishing Group, England (1988).
Marsh, J.W., et al., "Association of Relapse of Clostridium Difficile Disease With Bi/nap1/027," Journal of Clinical Microbiology, 50(12):4078-4082, American Society for Microbiology, United States, (Dec. 2012).
Martin et al., "Increasingly Frequent Diagnosis of Acute Gastrointestinal Graft-versus-Host Disease after Allogeneic Hematopoietic Cell Transplantation," Biol. Blood Marrow Transplant. 10:320-327 (2004).
Martinet., et al., "Irreversible Coupling of immunoglobulin Fragments to Preformed Vesicles", J. Biol. Chern., 1982, vol. 257, No. 1, pp. 286-288.
Martinez-Montiel, M.P., et al., "Pharmacologic Therapy for Inflammatory Bowel Disease Refractory to Steroids," Clinical and Experimental Gastroenterology 8:257-269, Dove Medical Press, New Zealand (Aug. 2015).
Maslowski, K.M. et al., "Diet, Gut Microbiota and Immune Responses," Nature Immunology, Jan. 2011, pp. 5-9, vol. 12, No. 1.
Matsuda, K. et al., "Sensitive Quantitative Detection of Commensal Bacteria by rRNA-targeted Reverse Transcription-PCR," Applied and Environmental Microbiology, 73(1):32-39, American Society for Microbiology, United States (Jan. 2007).
Maynard et al., "Reciprocal interactions of the intestinal microbiota and immune system," Nature 489:231-241 (2012).
Mbithi, J.N., et al., "Chemical Disinfection of Hepatitis a Virus on Environmental Surfaces," Applied and Environmental Microbiology, 56(11):3601-3604, American Society for Microbiology, United States (Nov. 1990).
McAuliffe et al., "Genetic Analysis of Two Bile Salt Hydrolase Activities in Lactobacillus acidophilus NCFM," Appl. Environ Microbial., 71(8):4925-4929 (2005).
McFarland, L.V., and Elmer, G.W., "Pharmaceutical Probiotics for the Treatment of Anaerobic and Other Infections," Anaerobe, 3(2-3):73-78, Academic Press, England (Apr.-Jun. 1997).
McFarland, L.V., "Use of Probiotics to Correct Dysbiosis of Normal Microbiota Following Disease or Disruptive Events: a Systematic Review," BMJ Open, 4(8):e005047, BMJ Publishing Group Ltd, England (Aug. 2014).

(56) References Cited

OTHER PUBLICATIONS

McGuire, G., et al., "Models of Sequence Evolution for Dna Sequences Containing Gaps," Molecular Biology and Evolution, 18(4):481-490, Oxford University Press, England (Apr. 2001).

McNulty, N.P., et al., "The Impact of a Consortium of Fermented Milk Strains on the Gut Microbiome of Gnotobiotic Mice and Monozygotic Twins," Science Translational Medicine, 3(106):106ra106, American Association for the Advancement of Science, United States (Oct. 2011).

Mevissen-Verhage, E.A., et al., "*Bifidobacterium, Bacteroides*, and *Clostridium* Spp. In Fecal Samples From Breast-fed and Bottle-fed Infants With and Without Iron Supplement," Journal of Clinical Microbiology, 25(2):285-289, American Society for Microbiology, United States (Feb. 1987).

Mexican Office Action, Mexican Application No. MX/a/2015/006491, dated Jun. 25, 2018, 8 pages, (with concise explanation of relevance).

Mexican Office Action, Mexican Application No. MX/a/2015/009991, dated Jul. 16, 2018, (with concise explanation of relevance).

Meyers, "Infection in Bone Marrow Transplant Recipients," The American Journal of Medicine 81(Suppl. 1A):27-38 (1986).

Mierau, L., et al., "Industrial-scale Production and Purification of a Heterologous Protein in Lactococcus Lactis Using the Nisin-controlled Gene Expression System Nice: the Case of Lysostaphin," Microbial Cell Factories, 4:15, BioMed Central, England (May 2005).

Miller, R.S., and Hoskins, L.C., "Mucin Degradation in Human Colon Ecosystems. Fecal Population Densities of Mucin-degrading Bacteria Estimated by a "Most Probable Number" Method," Gastroenterology, 81(4):759-765, W.B. Saunders, United States (Oct. 1981).

Miyamoto-Shinohara, Y., et al., "Survival of Freeze-dried Bacteria," The Journal of General and Applied Microbiology, 54(1):9-24, Microbiology Research Foundation, Japan (Feb. 2008).

M'koma, A.E., "Inflammatory Bowel Disease: an Expanding Global Health Problem," Clinical Medicine Insights. Gastroenterology 6:33-47, SAGE Publications, United States (Aug. 2013).

Momose, Y., et al., "16S rRNA Gene Sequence-based Analysis of Clostridia Related to Conversion of Germfree Mice to the Normal State," Journal of Applied Microbiology 107(6):2088-2097, Blackwell Science, England (Dec. 2009).

Morgan, C.A., et al., "Preservation of Micro-organisms by Drying; a Review," Journal of Microbiological Methods, 66(2):183-193, Elsevier Biomedical, Netherlands (Aug. 2006).

Morgan, R.A. and Anderson, W.F., "Human Gene Therapy," Annual Review of Biochemistry 62:191-217, Annual Reviews, United States (1993).

Morris, G.N., et al., "*Clostridium scindens* sp. nov., A Human Intestinal Bacterium with Desmolytic Activity on Corticoids," International Journal of Systematic and Evolutionary Microbiology 35(4):478-481, (Oct. 1985).

Mulligan, R.C., "The Basic Science of Gene Therapy," Science 260(5110):926-932, American Association for the Advancement of Science, United States (1993).

Murri, M., et al., "Gut Microbiota in Children With Type 1 Diabetes Differs From That in Healthy Children: a Case-control Study," BMC Medicine, 11:46, BioMed Central, England (Feb. 2013).

Myllyluoma, E., et al., "Effects of Multispecies Probiotic Combination on Helicobacter Pylori Infection in Vitro," Clinical and Vaccine Immunology, 15(9):1472-1482, American Society for Microbiology, United States (Sep. 2008).

Naaber, P., et al., "Inhibition of Clostridium Difficile Strains by Intestinal *Lactobacillus* Species," Journal of Medical Microbiology, 53(Pt 6):551-554, Microbiology Society, England (Jun. 2004).

Narushima, S., et al., "Characterization of the 17 Strains of Regulatory T Cell-Inducing Human-Derived Clostridia," Gut Microbes 5(3):333-339, Taylor & Francis, United States (May-Jun. 2014).

Needleman, S.B. and Wunsch, C.D., "A General Method Applicable to the Search for Similarities in the Amino Acid Sequence of Two Proteins," Journal of Molecular Biology 48(3):443-453, Academic Press, England (Mar. 1970).

New Zealand Examination Report, New Zealand Application No. 713298, dated Sep. 26, 2017, 5 pages.

New Zealand First Examination Report, New Zealand Application No. 709392, dated Oct. 5, 2015, 7 pages.

New Zealand First Examination Report, New Zealand Application No. 711771, dated Nov. 23, 2015, 6 pages.

New Zealand First Examination Report, New Zealand Application No. 711773, dated Nov. 24, 2015, 6 pages.

New Zealand First Examination Report, New Zealand Application No. 713298, dated Feb. 28, 2017, 6 pages.

New Zealand Fourth Examination Report, New Zealand Application No. 713298, dated Mar. 15, 2018, 2 pages.

New Zealand Second Examination Report, New Zealand Application No. 709392, dated Jun. 9, 2016, 7 pages.

New Zealand Third Examination Report, New Zealand Application No. 711771, dated Nov. 4, 2016, 4 pages.

New Zealand Third Examination Report, New Zealand Application No. 713298, dated Feb. 15, 2018, 6 pages.

Nicholson, W.L., and Law, J.F., "Method for Purification of Bacterial Endospores From Soils: Uv Resistance of Natural Sonoran Desert Soil Populations of *Bacillus* Spp. With Reference to B. Subtilis Strain 168," Journal of Microbiological Methods, 35(1):13-21, Elsevier Biomedical, Netherlands (Feb. 1999).

NIH human microbiome project, (http://www.hmpdacc.org/); Accessed Mar. 27, 2014.

Nishio, J., Atarashi, K., Tanoue, T., Baba, M., Negishi, H., Yanai, H., Honda, K., Benoist, C., Mathis, D., and Taniguchi, T. (2013). Impact of TCR repetoire on intestinal homeostasis (Taos, NM).

Nitert, M.D., et al., "Spring: an Rct Study of Probiotics in the Prevention of Gestational Diabetes Mellitus in Overweight and Obese Women," Bmc Pregnancy and Childbirth, 13:50, BioMed Central, England (Feb. 2013).

Nitzan, O., et al., "Role of Antibiotics for Treatment of Inflammatory Bowel Disease," World Journal of Gastroenterology, 22(3):1078-1087, Baishideng Publishing Group, United States (Jan. 2016).

Noack, J., et al., "Dietary Guar Gum and Pectin Stimulate Intestinal Microbial Polyamine Synthesis in Rats," The Journal of Nutrition, 128(8):1385-1391, American Society for Nutrition, United States (Aug. 1998).

Non Final Office Action dated Apr. 7, 2020, in U.S. Appl. No. 16/054,864, Gregory McKenzie et al., filed Aug. 3, 2018, 15 pages.

Non Final Office Action dated Mar. 15, 2019, in U.S. Appl. No. 16/054,864, Gregory McKenzie et al., filed Aug. 3, 2018, 9 pages.

Non Final Office Action dated Nov. 3, 2016, in U.S. Appl. No. 14/777,252, Henn, M.R., et al., filed Sep. 15, 2015.

Non Final Office Action dated Jan. 23, 2017, in U.S. Appl. No. 14/765,810, Maltzahn, G.V., et al., filed Aug. 4, 2015.

Non Final Office Action dated Aug. 29, 2017, in U.S. Appl. No. 14/777,252, Henn, M.R., et al., filed Sep. 15, 2015.

Non Final Office Action dated Apr. 17, 2018, in U.S. Appl. No. 14/765,814, 14 pages.

Non Final Office Action dated Jun. 15, 2018, in U.S. Appl. No. 15/359,439, 13 pages.

Non final Office action dated Mar. 21, 2019, in U.S. Appl. No. 14/765,812, Afey An; N. et al., filed Aug. 4, 2015, 10 pages.

Non Final Office Action dated Mar. 23, 2017, in U.S. Appl. No. 14/776,676, 8 pages.

Non Final Office Action dated Nov. 1, 2017, in U.S. Appl. No. 15/039,007, 12 pages.

Non final Office action dated Nov. 14, 2019, in U.S. Appl. No. 14/765,814, Cook; D. et al., filed Aug. 4, 2015, 17 pages.

Non Final Office Action dated Oct. 17, 2017, in U.S. Appl. No. 15/104,873, 6 pages.

Non Final Office Action dated Oct. 22, 2019, in U.S. Appl. No. 15/742,732, Cook, D. et al., filed Jan. 8, 2018, 10 pages.

Non-Final Office Action dated Oct. 29, 2019, in U.S. Appl. No. 15/990,539, Henn,M.R. et al., filed May 25, 2018, 25 pages.

Non-Final Office Action dated Dec. 9, 2019, in U.S. Appl. No. 16/223,008, Matthew R. Henn et al., filed Dec. 17, 2018, 17 pages.

(56) References Cited

OTHER PUBLICATIONS

Non-final Office Action dated Jul. 22, 2014, in U.S. Appl. No. 14/221,190, Henn, M.R., et al., filed Mar. 20, 2014.
Non-final Office Action dated Aug. 25, 2016, in U.S. Appl. No. 14/765,812, Afeyan, N.B., et al., filed Aug. 4, 2015.
Non-final Office Action dated Mar. 25, 2014, in U.S. Appl. No. 14/091,201, Henn, M.R., et al., filed Nov. 26, 2013.
Non-final Office Action dated Apr. 28, 2016, in U.S. Appl. No. 15/068,438, McKenzie, G., et al., filed Mar. 11, 2016.
Non-final Office Action dated Aug. 17, 2016, in U.S. Appl. No. 14/884,655, McKenzie, G., et al., filed Oct. 15, 2015.
Non-Final Office action dated Dec. 31, 2019, in U.S. Appl. No. 16/051,747, Maltzahn, G.V. et al., filed Aug. 1, 2018, 46 pages.
Non-Final Office Action dated Mar. 10, 2020, in U.S. Appl. No. 15/778,095, Button, J. et al., filed May 22, 2018, 28 pages.
Non-Final Office Action dated Mar. 23, 2020, in U.S. Appl. No. 15/990,539, Henn,M.R et al., filed May 25, 2018, 10 pages.
Non-final Office Action dated May 5, 2016, in U.S. Appl. No. 14/884,655, McKenzie, G., et al., filed Oct. 15, 2015.
Non-Patent Literature Submitted with Notice of Opposition to a European Patent, Jul. 18, 2017, European Patent No. EP2575835: Other Evidence, E102635, 1 page.
Nyangale, E.P., et al., "Gut Microbial Activity, Implications for Health and Disease: the Potential Role of Metabolite Analysis," Journal of Proteome Research, 11(12):5573-5585, American Chemical Society, United States (Dec. 2012).
Office Action dated Dec. 10, 2014, in U.S. Appl. No. 14/313,828, McKenzie, G., et al., filed Jun. 24, 2014.
Office Action dated Aug. 13, 2014, in U.S. Appl. No. 14/197,044, McKenzie, G., et al., filed Mar. 4, 2014.
Office Action dated Aug. 13, 2014, in U.S. Appl. No. 14/313,828, McKenzie, G., et al., filed Jun. 24, 2014.
Office Action dated May 15, 2015, in U.S. Appl. No. 14/313,828, McKenzie, G., et al., filed Jun. 24, 2014.
Office Action dated Aug. 19, 2016, in U.S. Appl. No. 14/592,481, Henn, M.R., et al., filed Jan. 8, 2015.
Office Action dated Dec. 22, 2015, in U.S. Appl. No. 14/592,481, Henn, M.R., et al., filed Jan. 8, 2015.
Office action dated Dec. 21, 2018, in U.S. Appl. No. 15/986,369, Pamer; E. et al., filed May 22, 2018, 15 pages.
Office Action dated Feb. 25, 2014, in European Patent Application No. 11728077.6 filed Jun. 3, 2011.
Office Action dated Feb. 26, 2019, in U.S. Appl. No. 15/312,610, Pamer, E. et al., filed Nov. 18, 2016, 22 pages.
Office action dated Jan. 13, 2020, in U.S. Appl. No. 15/986,369, Pamer; E. et al., filed May 22, 2018, 10 pages.
Office Action dated Jul. 10, 2018, in U.S. Appl. No. 15/312,610, Pamer,E. et al., filed Nov. 18, 2016, 16 pages.
Office Action dated Mar. 28, 2019, in U.S. Appl. No. 15/603,916, VanDenBrink; M. et al., filed May 24, 2017, 24 pages.
Office Action dated May 14, 2019, in U.S. Appl. No. 15/603,916, VanDenBrink; M. et al., filed May 24, 2017, 25 pages.
Office Action dated Nov. 13, 2019, in U.S. Appl. No. 15/603,916, VanDenBrink; M. et al., filed May 24, 2017, 21 pages.
Office action dated Oct. 22, 2019, in U.S. Appl. No. 151742,732, Cook; D. et al., filed Jan. 8, 2018, 10 pages.
Office Action dated Sep. 18, 2015, in European Patent Application No. 11728077.6 filed Jun. 3, 2011.
Office action dated Sep. 20, 2019, in U.S. Appl. No. 15/986,369, Pamer; E. et al., filed May 22, 2018, 10 pages.
O'Garra, A., et al., "IL-10-producing and Naturally Occurring CD4+ Tregs: Limiting Collateral Damage," The Journal of Clinical Investigation 114(10):1372-1378, American Society for Clinical Investigation, United states (Nov. 2004).
O'Hara, C.M., et al., "Classification, Identification, and Clinical Significance of Proteus, Providencia, and Morganella," Clinical Microbiology Reviews, 13(4):534-546, American Society for Microbiology, United States (Oct. 2000).
Okada, Y., et al., "Effects of Fecal Microorganisms and Their Chloroform-resistant Variants Derived From Mice, Rats, and Humans on Immunological and Physiological Characteristics of the Intestines of Ex-germfree Mice," Infection and Immunity, 62(12):5442-5446, American Society for Microbiology, United States (Dec. 1994).
Olle, B., "Medicines From Microbiota," Nature Biotechnology, 31(4):309-315, Nature America Publishing, United States (Apr. 2013).
OpenBiome. Quality metrics. (http://static.squarespace.com/static/ 50e0c29ae4b0a05702af7e6a/t/52e19b89e4b0b28f802c9b4e/ 1390517129976/0penBiome%20Quality%20Metrics.pdf) Accessed Mar. 21, 2014.
Ott, S.J., et al., "Quantification of Intestinal Bacterial Populations by Real-time Pcr With a Universal Primer Set and Minor Groove Binder Probes: a Global Approach to the Enteric Flora," Journal of Clinical Microbiology, 42(6):2566-2572, American Society for Microbiology,United States, (Jun. 2004).
Out, C., et al., "Bile Acid Sequestrants: More Than Simple Resins," Current opinion in lipidology, 23(1):43-55, Lippincott Williams & Wilkins, England, (Feb. 2012).
Owens, C., et al., "Fecal Microbiota Transplantation and Donor Standardization," Trends In Microbiology, 21(9):443-445, Elsevier Trends Journals, England (Sep. 2013).
Paine, R.T., "A Note on Trophic Complexity and Community Stability," American Naturalist, 102(929):91-93, The University of Chicago Press for The American Society of Naturalists, United States (Jan.-Feb. 1969).
Palmfeldt, J., and Hahn-Hägerdal, B., "Influence of Culture pH on Survival of Lactobacillus Reuteri Subjected to Freeze-drying," International Journal of Food Microbiology, 55(1-3):235-238, Elsevier Science Publishers, Netherlands (Apr. 2000).
Pamer, E.G., "Fecal Microbiota Transplantation: Effectiveness, Complexities, and Lingering Concerns," Mucosal Immunology, 7(2):210-214, Nature Publishing Group, United States (Mar. 2014).
Papadimitriou, K. et al., "Discovering Probiotic Microorganisms: in Vitro, in Vivo, Genetic and Omics Approaches," Frontiers In Microbiology, 6:58, Frontiers Research Foundation, Switzerland (Feb. 2015).
Paredes-Sabja, D., et al., "Inorganic Phosphate and Sodium Ions Are Cogerminants for Spores of Clostridium perfringens Type A Food Poisoning-Related Isolates," Applied and Environmental Microbiology, 75(19):6299-6305, American Society for Microbiology, United States (Oct. 2009).
Parham et al., "A Receptor for the Heterodimeric Cytokine IL-23 is Composed of IL-12R~1 and a Novel Cytokine Receptor Subunit, IL-23R1," J Immunol 168:5699-5708-2002.
Park et al., "*Blautia faecis* sp. nov., isolated from human faeces," Int J Syst Evol Microbial. 63:599-603 (2013).
Partial Supplementary European Search Report dated Jan. 4, 2018 in Application No. 15796000.6.
Passweg et al., "Influence of protective isolation on outcome of allogeneic bone marrow transplantation for leukemia," Bone Marrow Transplantation 21:1231-1238 (1998).
Path Vaccine and Pharmaceutical Technologies Group. Summary of stability data for investigational formulations of vaccines. (http:// www.path.org/publications/files/TS_vaccine_stability_table_invest. pdf) Accessed Mar. 21, 2014.
PCT Invitation To Pay Additional Fees, PCT Application No. PCT/US13/71758, dated Feb. 25, 2014, 4 pages.
PCT Invitation to Pay Additional Fees, PCT Application No. PCT/US14/14745, dated May 16, 2014, 2 pages.
PCT Invitation To Pay Additional Fees, PCT Application No. PCT/US14/29539, dated Jul. 31, 2014, 3 pages.
PCT Invitation To Pay Additional Fees, PCT Application No. PCT/US14/70684, dated Mar. 24, 2015, 2 pages.
PCT Invitation To Pay Additional Fees, PCT Application No. PCT/US2014/014738, dated May 16, 2014, 2 pages.
PCT Invitation To Pay Additional Fees, PCT Application No. PCT/US2014/030817, dated Sep. 8, 2014, 5 pages.
Peck, M.W. et al., "Development and Application of a New Method for Specific and Sensitive Enumeration of Spores of Nonproteolytic Clostridium Botulinum Types B, E, and F in Foods and Food

(56) References Cited

OTHER PUBLICATIONS

Materials," Applied and Environmental Microbiology, 76(19):6607-6614, American Society for Microbiology, United States (Oct. 2010).

Pehkonen, K.S., et al., "State Transitions and Physicochemical Aspects of Cryoprotection and Stabilization in Freeze-drying of Lactobacillus Rhamnosus GG (LGG)," Journal of Applied Microbiology, 104(6):1732-1743, Society for Applied Bacteriology by Blackwell Science, England (Jun. 2008).

Peighambardoust, S.H., et al., "Application of Spray Drying for Preservation of Lactic Acid Starter Cultures: a Review," Trends in Food Science & Technology, 22(5):215-224, Elsevier Ltd, Netherlands (May 2011).

Pei-Show Juo., The Concise Dictionary of Biomedicine and Molecular Biology, 2nd Edition, CRC Press, United States (2002).

Pelaseyed et al., "The mucus and mucins of the goblet cells and enterocytes provide the first defense line of the gastrointestinal tract and interact with the immune system," Immunological Reviews 260:8-20 (2014).

Pellegrino, P.M., et al., "Enhanced Spore Detection Using Dipicolinate Extraction Techniques," Analytica Chimica Acta, 455(2):167-177, Elsevier Ltd, Netherlands (Mar. 2002).

Perez, F., et al., "Effect of Antibiotic Treatment on Establishment and Elimination of Intestinal Colonization by Kpc-producing Klebsiella Pneumoniae in Mice," Antimicrobial Agents and Chemotherapy, 55(6):2585-2589, American Society for Microbiology, United States (Jun. 2011).

Perez, J., et al., "Oospore: a Liquid Medium for Producing High Titers of Semi-purified Spores of Clostridium Difficile," Journal of AOAC International, 94(2):618-626, AOAC International, United States (Mar.-Apr. 2011).

Petersen, F. B., et al., "Infectious Complications m Patients Undergoing Marrow Transplantation: A Prospective Randomized Study of the Additional Effect of Decontamination and Laminar Airflow Isolation among Patients Receiving Prophylactic Systemic Antibiotics," Scand J. Infect Dis. 19(5):559-567 (1987).

Peterson, D.A. et al., "Metagenomic Approaches for Defining the Pathogenesis of Inflammatory Bowel Diseases," Cell Host & Microbe, 3(6):417-427, Cell Press, United States (Jun. 2008).

Petrof, E.O., et al., "Microbial Ecosystems Therapeutics: a New Paradigm in Medicine?," Beneficial Microbes, 4(1):53-65, Wageningen Academic Publishers, Netherlands (Mar. 2013).

Petrof, E.O., et al., "Stool Substitute Transplant Therapy for the Eradication of Clostridium Difficile Infection: 'Repoopulating' the Gut," Microbiome 1(1):3, BioMed Central, England (Jan. 2013).

Pharmacy, 2011, pp. 79-86, vol. 62, No. 3. [With English Main Sub-Points].

Picot, A., and Lacroix, C., "Encapsulation of Bifidobacteria in Whey Protein-based Microcapsules and Survival in Simulated Gastrointestinal Conditions and in Yoghurt," International Dairy Journal, 14(6):505-515, Elsevier Ltd, Netherlands (Jun. 2004).

Pillai, A. et al., "Probiotics for Treatment of Clostridium Difficile-Associated Colitis in Adults (Review)," Cochrane Database of Systematic Reviews, The Cochrane Collaboration, John Wiley & Sons, Ltd., 2010, 18 pages.

Pinn, D. et al. (2013). Follow-up Study of Fecal Microbiota Transplantation (FMT) for the Treatment of Refractory Irritable Bowel Syndrome (IBS). Abstract ACG 2013.

Pittelkow, M.R. and Scott, R.E., "New Techniques for the in Vitro Culture of Human Skin Keratinocytes and Perspectives on Their Use for Grafting of Patients With Extensive Burns," Mayo Clinic Proceedings 61(10):771-777, Elsevier, England (Oct. 1986).

Plassart, C., et al., "First Case of Intra-abdominal Infection With Clostridium Disporicum," Anaerobe, 19:77-78, Academic Press, England (Feb. 2013).

Ponce et al., "Graft-versus-Host Disease after Double-Unit Cord Blood Transplantation Has Unique Features and an Association with Engrafting Unit-To-Recipient HLA Match," Biol. Blood Marrow Transplant 19:904-911(2013).

Porada et al., "Treatment of Hemophilia A in Utero and Postnatally using Sheep as a Model for Cell and Gene Delivery," J. Genet Syndr Gene Ther., 25:Suppl. 1, 26 pages 2012).

Postgate, Jr., and Hunter, J.R., "On the Survival of Frozen Bacteria," Journal of General Microbiology, 26:367-378, Society for General Microbiology, England (Nov. 1961).

Potentials of Probiotics in Pig Nutrition, AllAboutFeed News, Jan. 31, 2007, 6 pages.

Prilassnig, M. et al., "Are Probiotics Detectable in Human Feces After Oral Uptake by Healthy Volunteers?," Wiener Klinische Wochenschrift, 119(15-16):456-462, Springer, Austria (Aug. 2007).

Priority Document JP 2010-129134 for PCT Application No. PCT/JP2011/063302, Filed June 4, 201 0, 42 pages.

Priority Document PCT/JP2010/071746 for PCT Application No. PCT/JP2011/063302, Filed Dec. 3, 2010, 107 pages.

Prioul T, G. et al., "Effect of Probiotic Bacteria on Induction and Maintenance of Oral Tolerance to β-Lactoglobulin in Gnotobiotic Mice," Clinical and Vaccine Immunology, 10(5):787-792, American Society for Microbiology, United States (Sep. 2003).

Pultz, N.J., et al., "Inhibition of Methicillin-resistant *Staphylococcus aureus* by an in Vitro Continuous-flow Culture Containing Human Stool Microflora," FEMS Microbiology Letters, 241(2):201-205, Oxford Oxford University Press, England (Dec. 2004).

Qiu, X., et al., "Faecalibacterium prausnitzii Upregulates Regulatory T Cells and Anti-Inflammatory Cytokines In Treating TNBS-Induced Colitis," Crohn's and Colitis 7(11):e558-e568, Elsevier Science, England (Dec. 2013 ).

Queenan, A.M., and Bush, K., "Carbapenemases: the Versatile Beta-lactamases," Clinical Microbiology Reviews, 20(3):440-458, American Society for Microbiology, United States (Jul. 2007).

Quigley, E.M., and Quera, R., "Small Intestinal Bacterial Overgrowth: Roles of Antibiotics, Prebiotics, and Probiotics," Gastroenterology, 130(2 Suppl 1):S78-S90, W.B. Saunders, United States (Feb. 2006).

Raibaud, P., et al., "Implantation of Bacteria From the Digestive Tract of Man and Various Animals Into Gnotobiotic Mice," The American Journal of Clinical Nutrition, 33(11 Suppl):2440-2447, American Society of Clinical Nutrition, United States (Nov. 1980).

Rakoff-Nahoum, S., et al., "Recognition of Commensal Microflora by Toll-like Receptors is Required for Intestinal Homeostasis," Cell, 118(2):229-241, Cell Press, United States, (Jul. 2004).

Ramirez, N., and Abel-Santos, E., "Requirements for Germination of Clostridium sordellii Spores In Vitro," Journal of Bacteriology, 192(2):418-425, American Society for Microbiology, United States (Jan. 2010).

Rao, A.V., et al., "Survival of Microencapsulated Bifidobacterium Pseudolongum in Simulated Gastric and Intestinal Juices," Canadian Institute of Food Science and Technology Journal, 22(4):345-349, Elsevier Ltd, Netherlands (Oct. 1989).

Rasti et al., "Inhibition of Clostridium scindens and Clostridium hiranonis growth by Bifidobacterium pseudocatenulatum G4 in simulated colonic pH," Journal of Food Agriculture and Environment 11(2): 127-131, WFL Publisher Ltd, Poland (2013).

Rea, M.C., et al., "Effect of Broad- and Narrow-spectrum Antimicrobials on Clostridium Difficile and Microbial Diversity in a Model of the Distal Colon," Proceedings of the National Academy of Sciences of the United States of America, 108 Suppl 1:4639-4644, National Academy of Sciences, United States, (Mar. 2011).

Rea, M.C.,et al., "Thuricin Cd, a Posttranslationally Modified Bacteriocin With a Narrow Spectrum of Activity Against Clostridium Dif.ficile," Proceedings of the National Academy of Sciences of the United States of America, 107(20):9352-9357, National Academy of Sciences, (May 2010).

Reeves, A.E., et al., "Suppression of Clostridium Difficile in the Gastrointestinal Tracts of Germfree Mice Inoculated With a Murine Isolate From the Family Lachnospiraceae," Infection and Immunity, 80(11):3786-3794, American Society for Microbiology, United States (Nov. 2012).

Reeves, A.E.,et al., "The Interplay Between Microbiome Dynamics and Pathogen Dynamics in a Murine Model of Clostridium Difficile Infection.," Gut Microbes, 2(3):145-158, Philadelphia, PA : Taylor & Francis, (May 2011).

(56) References Cited

OTHER PUBLICATIONS

Rehman, A. et al., "Effects of Probiotics and Antibiotics on the Intestinal Homeostasis in a Computer Controlled Model of the Large Intestine," BMC Microbiology, 12:47, BioMed Central, England (Mar. 2012).
Response of Jan. 28, 2015 in Examination, European Application No. 11728077.6, 3 pages.
Response to Official Communication dated Sep. 18, 2018, European Application No. 11728077.6, filed Nov. 18, 2015 , 2 pages.
Rexroad, J., et al., "Lyophilization and the Thermostability of Vaccines," Cell Preservation Technology, 1(2):91-104, Mary Ann Liebert, Inc, United States (Jun. 2002).
Rheinwald, J.G., "Chapter 15 Serial Cultivation of Normal Human Epidermal Keratinocytes," Methods in Cell Biology 21A:229-254, Academic Press, United States (1980).
Rid Aura, V.K., et al., "Gut Microbiota From Twins Discordant for Obesity Modulate Adiposity and Metabolic Phenotypes in Mice," Science, 341(6150):1241214, American Association for the Advancement of Science, United States (Sep. 2013).
Ridlon, J.M and Hylemon, P.B., "Identification and Characterization of Two Bile Acid Coenzyme a Transferases From Clostridium Scindens, a Bile Acid 7α-dehydroxylating Intestinal Bacterium.," Journal of Lipid Research, 53(1):66-76, American Society for Biochemistry and Molecular Biology, United States, (Jan. 2012).
Ridlon, J.M., "Enzymology and Molecular Biology of Bile Acid 7alpha- And 7beta-Dehydroxylation By The Intestinal Bacteria Clostridium Scindens And Clostridium Hylemonae," VCU Theses and Dissertations, Paper 736 (2008).
Ridlon, J.M.,et al., "Clostridium Scindens: a Human Gut Microbe With a High Potential to Convert Glucocorticoids Into Androgens.," Journal of Lipid Research, 54(9):2437-2449, American Society for Biochemistry and Molecular Biology, United States, (Sep. 2013).
Ridlon,J.M,.et al., "Bile Salt Biotransformations by Human Intestinal Bacteria.," Journal of Lipid Research, 47(2):241-259, American Society for Biochemistry and Molecular Biology, (Feb. 2006).
Roberts, B., "Generation and Development of Defined Microbial Drug Products," Vedanta Biosciences, 17 pages (2016).
Robinson, I.M. et al., "Emendation of Acetivibrio and Description of Acetivibrio Ethanolgignens, a New Species From the Colons of Pigs With Dysentery," International Journal of Systematic Bacteriology , 31(3):333-338 (Jul. 1981).
Rode, L.J., and Foster, J.W., "Germination of Bacterial Spores With Alkyl Primary Amines1," Journal of Bacteriology, 81(5):768-779, American Society for Microbiology, United States (May 1961).
Roffe, C., "Biotherapy for Antibiotic-associated and Other Diarrhoeas," The Journal of infection, 32(1):1-10, W.B. Saunders, England (Jan. 1996).
Rohleke, F., et al., "Fecal Flora Reconstitution for Recurrent Clostridium Difficile Infection: Results and Methodology," Journal of Clinical Gastroenterology, 44(8):567-570, Wolters Kluwer Health, Inc, United States (Sep. 2010).
Rosen, D.L., et al., "Bacterial Spore Detection and Determination by Use of Terbium Dipicolinate Photoluminescence," Analytical Chemistry, 69(6):1082-1085, American Chemical Society, United States (1997).
Rosero, J.A., et al., "Reclassification of Eubacterium Rectale (Hauduroy et al. 1937) Prévot 1938 in a New Genus *Agathobacter* Gen. Nov. As *Agathobacter rectalis* Comb. Nov., and Description of *Agathobacter ruminis* Sp. Nov., Isolated From the Rumen Contents of Sheep and Cows," International Journal of Systematic and Evolutionary Microbiology, 66(2):768-773, Microbiology Society, England (Feb. 2016).
Rossen, N.G., et al., "Findings From a Randomized Controlled Trial of Fecal Transplantation for Patients With Ulcerative Colitis.," Gastroenterology, 149(1):110-118, W.B. Saunders, United States (Jul. 2015).
Rossi, O., et al., "Faecalibacterium Prausnitzii A2-165 has a High Capacity to Induce IL-10 in Human and Murine Dendritic Cells and Modulates T Cell Responses," Scientific Reports 6:12 pages, (Jan. 2015).
Rowlings, P. A., et al., "IBMTR Severity Index for grading acute graft-versus-host disease: retrospective comparison with Glucksberg grade," Br J Haematol. 97:855-864 (1997).
Rubin, E. and Farber, J.L., "Pathology," Second Edition, Philadelphia, J. B. Lippincott Company (1994).
Rupnik, M.,et al., "Clostridium Difficile Infection: New Developments in Epidemiology and Pathogenesis.," Nature Reviews. Microbiology, 7(7):526-536, Nature Pub. Group, c2003-,England, (Jul. 2009).
Russell, A.D., "The Destruction of Bacterial Spores," 1982, pp. 191-193.
Russell et al., "Early Outcomes After Allogeneic Stem Cell Transplantation for Leukemia and Myelodysplasia Without Protective Isolation: A 1 0-year Experience," Biol. Blood Marrow Transplant 6(2):109-114(2000).
RussianFirst Office Action, Russian Patent Application No. 2015124366, dated Dec. 13, 2016, 12 pages.
Russian Office Action, Russian Application No. 2015137399, dated Mar. 22, 2016, 8 pages.
Russian Office Action, Russian Application No. 201537399, dated Aug. 15, 2016, 8 pages.
Russian Second Office Action, Russian Application No. 2015124366, dated Feb. 12, 2018, 10 pages.
Russian Second Office Action, Russian Patent Application No. 2015137399, dated Mar. 14, 2017, 8 pages.
Sack, D.A., et al., "Comparison of Alternative Buffers for Use With a New Live Oral Cholera Vaccine, Peru-15, in Outpatient Volunteers," Infection and Immunity, 65(6):2107-2111, American Society for Microbiology, United States (Jun. 1997).
Sacks, L.E. and Alderton, G., "Behavior of Bacterial Spores in Aqueous Polymer Two-phase Systems," Journal of Bacteriology, 82(3):331-341, American Society for Microbiology, United States (Sep. 1961).
Sahlstrom, L., et al., "A Laboratory Study of Survival of Selected Microorganisms After Heat Treatment of Biowaste Used in Biogas Plants," Bioresource Technology, 99(16):7859-7865, Elsevier Science Pub. Co., England (Nov. 2008).
Sakamoto et al., "Eubacterium limosum strain JCM 6421 16S ribosomal RNA gene, partial sequence" NCBI Reference Sequence, 2 pages, Nov. 23, 2016.
Salzman et al., "Analysis of 16S libraries of mouse gastrointestinal microflora reveals a large new group of mouse intestinal bacteria," Microbiology 148:3651-3660 (2002).
Sanchez, A.M. and Yang, Y., "The Role of Natural Regulatory T Cells in Infection," Immunologic Research 49(1-3):124-134, Humana Press, United states (Apr. 2011).
Santivarangkna, C., et al., "Alternative Drying Processes for the Industrial Preservation of Lactic Acid Starter Cultures," Biotechnology Progress, 23(2):302-315, Wiley-Blackwell, United States (Mar.-Apr. 2007).
Sartor, R.B., "Therapeutic Correction of Bacterial Dysbiosis Discovered by Molecular Techniques," Proceedings of the National Academy of Sciences of the United States of America 105(43):16413-16414, National Academy of Sciences, United states (Oct. 2008).
Sattar, S.A., et al., "Foodbome Spread of Hepatitis a: Recent Studies on Virus Survival, Transfer and Inactivation," The Canadian Journal of Infectious Diseases, 11(3):159-163, Pulsus Group, Inc., Canada (May-Jun. 2000).
Savaiano, D.A., et al., "1040 A Novel High Purity Short-Chain Galacto-Oligosaccharide (RP-G28) Improves Lactose Digestion and Symptoms of Lactose Intolerance," Gastroenterology, 142(5 Supp 1):S-182, Elsevier Inc, Netherlands (May 2012).
Savaiano, D.A., et al., "Improving Lactose Digestion and Symptoms of Lactose Intolerance With a Novel Galacto-oligosaccharide (Rp-g28): a Randomized, Double-blind Clinical Trial," Nutrition Journal, 12:160, BioMed Central, England (Dec. 2013).
Schloss, P.D., et al., "Introducing Mothur: Open-source, Platform-independent, Community-supported Software for Describing and Comparing Microbial Communities," Applied and Environmental Microbiology 75(23):7537-7541, American Society for Microbiology, United States (Dec. 2009).

(56) References Cited

OTHER PUBLICATIONS

Schloss, P.D., et al., "Reducing the Effects of Pcr Amplification and Sequencing Artifacts on 16s Rrna-based Studies," PLoS One 6(12):e27310, Public Library of Science, United States (Dec. 2011).
Schwab et al., "Neutrophil granulocytes recruited upon translocation of intestinal bacteria enhance graft-versus-host disease via tissue damage," Nature Medicine 20(6):648-654-2014.
Seale, R.B., et al., "Recovery of Spores From Thermophilic Dairy Bacilli and Effects of Their Surface Characteristics on Attachment to Different Surfaces," Applied and Environmental Microbiology, 74(3):731-737, American Society for Microbiology, United States (Feb. 2008).
Segata et al., "Metagenomic biomarker discovery and explanation," Genome Biol. 12:R60-2011.
Seguy et al., "Enteral Feeding and Early Outcomes of Patients Undergoing Allogeneic Stem Cell Transplantation following Myeloablative Conditioning," Transplantation 82:835-839 (2006).
Seki, H., et al., "Prevention of Antibiotic-Associated Diarrhea in Children by Clostridium Butyricum Miyairi," Pediatrics International, 45(1):86-90, Blackwell Science Asia, Australia (Feb. 2003).
Seo, M., et al., "Clostridium Butyricum Miyairi 588 Improves High-fat Diet-induced Non-alcoholic Fatty Liver Disease in Rats," Digestive Diseases and Sciences, 58(12):3534-3544, Springer Science + Business Media, United States (Dec. 2013).
Sequence Listing, PCT Application No. PCT/JP2011/063302, 43 pages, Dec. 8, 2011.
Setlow, B., et al., "Analysis of the Germination Kinetics of Individual Bacillus Subtilis Spores Treated With Hydrogen Peroxide or Sodium Hypochlorite," Letters in Applied Microbiology, 57(4):259-265, Published for the Society for Applied Bacteriology by Blackwell Scientific Publications, England (Oct. 2013).
Setlow, B., et al., "Germination of Spores of Bacillus Subtilis With Dodecylamine," Journal of Applied Microbiology, 95(3):637-648, Oxford : Published for the Society for Applied Bacteriology by Blackwell Science, England (2003).
Setlow, B., et al., "Mechanisms of Killing Spores of Bacillus Subtilis by Acid, Alkali and Ethanol," Journal of Applied Microbiology, 92(2):362-375, Published for the Society for Applied Bacteriology by Blackwell Science, England (2002).
Sghir, A., et al., "Quantification of Bacterial Groups Within Human Fecal Flora by Oligonucleotide Probe Hybridization," Applied and Environmental Microbiology 66(5):2263-2266, American Society for Microbiology, United States (May 2000).
Shafaat, H.S., and Ponce, A., "Applications of a Rapid Endospore Viability Assay for Monitoring UV Inactivation and Characterizing Arctic Ice Cores," Applied and Environmental Microbiology, 72(10):6808-6814, American Society for Microbiology, United States (Oct. 2006).
Shah, I.M., et al., "A Eukaryotic-like Ser/Thr Kinase Signals Bacteria to Exit Dormancy in Response to Peptidoglycan Fragments," Cell, 135(3):486-496, Cell Press, United States (Oct. 2008).
Shah, N.P. et al., "Microencapsulation of Probiotic Bacteria and Their Survival in Frozen Fermented Dairy Desserts," The Australian Journal of Dairy Technology, Oct. 2000, pp. 139-144, vol. 55, No. 3.
Shah, N.P., "Symposium: Probiotic Bacteria: Probiotic Bacteria: Selective Enumeration and Survival in Dairy Foods," Oct. 7, 1999, 14 pages.
Shah, S. (2012). Clostridium difficile in inflammatory Bowel Disease: a dangerous mix (Clostridium difficile Symposium, Miriam Hospital, Providence, RI).
Shahinas, D., et al., "Toward an Understanding of Changes in Diversity Associated With Fecal Microbiome Transplantation Based on 16S rRNA Gene Deep Sequencing," 3(5):e00338-12, American Society for Microbiology, United States (Oct. 2012).
Shannon, "The Mathematical Theory of Communication," M.D. Computing 14( 4): 3 06-317 (1997).
Sharpe, E.S. et al., "Separation of Spores and Parasporal Crystals of Bacillus Thuringiensis in Gradients of Certain X-ray Contrasting Agents," Applied Microbiology, 30(6):1052-1053, American Society for Microbiology, United States (Dec. 1975).
Sheneman, L.,et al., "Clearcut: a Fast Implementation of Relaxed Neighbor Joining.," Bioinformatics (Oxford, England), 22(22):2823-2824, Oxford University Press, c1998,England, (Nov. 2006).
Sheptulin, A.A., "Refractory and Relapsing Forms of Clostridium difficile-Associated Colitis," www.gastro-j.ru, 2011, pp. 50-53 (with English abstract).
Sheu, T.Y., et al., "Improving Survival of Culture Bacteria in Frozen Desserts by Microentrapment," Journal of Dairy Science, 76(7):1902-1907, American Dairy Science Association, United States (Jul. 1993).
Shono et al., "A Small-Molecule c-Rel Inhibitor Reduces Alloactivation of T Cells without Compromising Antitumor Activity," Cancer Discovery 4(5):578-591 (2014).
Siaterlis, A., et al., "Effect of Culture Medium and Cryoprotectants on the Growth and Survival of Probiotic Lactobacilli During Freeze Drying," Letters in Applied Microbiology, 48(3):295-301, Published for the Society for Applied Bacteriology by Blackwell Scientific Publications, England (Mar. 2009).
Sigma-Tau. VSL#3. http://www.vsl3.com/; Accessed Mar. 21, 2014.
Skaar, E., "The Battle for Iron between Bacterial Pathogens and Their Vertebrate Hosts," PLoS Pathogens, 6(8):e1000949, Public Library of Science, United States (Aug. 2010).
Sleator, R.D., Hill, C., "Designer Probiotics: a Potential Therapeutic for Clostridium Difficile?," Journal of Medical Microbiology, 57(Pt 6):793-794, Microbiology Society, England (Jun. 2008).
Smith, P.M., et al., "The Microbial Metabolites, Short-Chain Fatty Acids, Regulate Colonic Treg Cell Homeostasis," Science 341(6145):569-573, American Association for the Advancement of Science, United States (Aug. 2013 ).
Snitkin, E.S., et al., "Tracking a Hospital Outbreak of Carbapenem-resistant Klebsiella Pneumoniae With Whole-genome Sequencing," Science Translational Medicine, 4(148):148ra116, American Association for the Advancement of Science, United States (Aug. 2012).
Sokol, H., et al., "Faecalibacterium Prausnitzii Is an Anti-Inflammatory Commensal Bacterium Identified By Gut Microbiota Analysis of Crohn Disease Patients," Proceedings of the National Academy of Sciences 105(43):16731-16736, National Academy of Sciences, United States (Oct. 2008).
Sokol, H., et al., "Low Counts of Faecalibacterium Prausnitzii in Colitis Microbiota," Inflammatory Bowel Diseases 15(8):1183-1189, Lippincott Williams & Wilkins, nited States (Aug. 2009).
Solanki, H.K., et al., "Development of Microencapsulation Delivery System for Long-term Preservation of Probiotics as Biotherapeutics Agent," BioMed Research International, 2013:620719, Hindawi Pub. Co., United States (2013).
Solomkin et al., "Diagnosis and Management of Complicated Intra-abdominal Infection in Adults and Children: Guidelines by the Surgical Infection Society and the Infectious Diseases Society of America," Clin Infect Dis. 50:133-164 (2010).
Song, Y., et al., "Clostridiumboltei partial 16S rRNA gene, strain 16351" Database NCBI Nucleotide [online] accession No. AJ508452, Apr. 18, 2003, [retrieved on Dec. 22, 2020], retrieved from the internet: url: https://www.ncbi.nlm.nih.gov/nuccore/AJ508452, 2 pages.</url:>.
SOP No. MB-28-00. http://www.epa.gov/pesticides/methods/MB-28-00.pdf; Accessed 27th Match 2014.
Sorg et al., "Bile Salts and Glycine as Cogerminants for Clostridium dif.ficile Spores," J. Bacteriology 190(7):2505-2512 (2008).
Sorg, J.A., and Sonenshein, A.L., "Bile Salts and Glycine as Cogerminants for Clostridium Difficile Spores," Journal of Bacteriology, 190(7):2505-2512, American Society for Microbiology, United States (Apr. 2008).
Sorg, J.A. and Sonenshein, A.L., "Chenodeoxycholate is an Inhibitor of Clostridium Difficile Spore Germination.," Journal of Bacteriology, 191(3):1115-1117, American Society for Microbiology,United States, (Feb. 2009).
Sow, H., et al., "Heat Inactivation of Hepatitis a Virus and a Norovirus Surrogate in Soft-shell Clams (*Mya arenaria*)," Foodborne Pathogens and Disease, 8(3):387-393, Mary Ann Liebert, Inc., United States (Mar. 2011).

(56) References Cited

OTHER PUBLICATIONS

Stackebrandt, E., et al., "Taxonomic Note: A Place for DNA-DNA Reassociation and 16s rRNA Sequence Analysis in the Present Species Definition in Bacteriology ," International Journal of Systematic Bacteriology 44 (4):846-849, (Oct. 1994).

Stams, A.J.M., et al., "Growth of Syntrophic Propionate-Oxidizing Bacteria with Fumarate in the Absence of Methanogenic Bacteria," Applied and Environmental Microbiology, 59(4):1114-1119, American Society for Microbiology, United States (Apr. 1993).

Stefka, A.T., et al., "Commensal Bacteria Protect Against Food Allergen Sensitization," Proceedings of the National Academy of Sciences of the United States of America, 111(36):13145-13150, National Academy of Sciences, United States (Sep. 2014).

Stein, R.R.,et al., "Ecological Modeling From Time-series Inference: Insight Into Dynamics and Stability of Intestinal Microbiota.," Plos Computational Biology, 9(12):1003388, Public Library of Science, [2005], United States , (Sep. 2013).

Siemple, D.L. and Anderson, D.J., "Isolation of a Stem Cell for Neurons and Glia From the Mammalian Neural Crest," Cell 71(6):973-985, Cell Press, United States (Dec. 1992).

Stevens, K.A., and Jaykus, L.A., "Bacterial Separation and Concentration From Complex Sample Matrices: a Review," Critical Reviews in Microbiology, 30(1):7-24, Informa Healthcare, England (2004).

Storb et al., "Graft-Versus-Host Disease and Survival in Patients with Aplastic Anemia Treated by Marrow Grafts from HLA-Identical Siblings. Beneficial Effect of a Protective Environment," N Engl J Med. 308:302-307 (1983).

Su, W.J., et al., "Role of Volatile Fatty Acids in Colonization Resistance to Clostridium Difficile in Gnotobiotic Mice," Infection and Immunity, 55(7):1686-1691, American Society for Microbiology, United States (Jul. 1987).

Sudarsanam, P., et al., "[Clostridium] Bolteae ATCC BAA-613 C_bolteae-3.0.1_Cont299, Whole Genome Shotgun Sequence," Database NCBI Nucleotide [online] accession No. ABCC02000039, Jan. 14, 2008, [retrieved on Dec. 22, 2020], retrieved from the internet:< url:< a="" href="https://www.ncbi.nlm.nih.gov/nuccore/ABCC02000039.1/">https://www.ncbi.nlm.nih.gov/nuccore/ABCC02000039.1/, 99 pages.</url:>.

Supplementary Partial European Search Report dated Jun. 14, 2018 in Application No. EP 15862844.

Surawicz, C.M and Alexander, J., "Treatment of Refractory and Recurrent Clostridium Difficile Infection," Nature Reviews Gastroenterology & Hepatology, 8(6):330-339, Nature Publishing Group, England (Jun. 2011).

Swidsinski et al., "Spatial Organization and Composition of the Mucosal Flora in Patients with Inflammatory Bowel Disease," Journal of Clinical Microbiology 43(7):3380-3389-2005.

Takaishi, H., et al., "Imbalance in Intestinal Microflora Constitution Could Be Involved In the Pathogenesis of Inflammatory Bowel Disease," International Journal of Medical Microbiology 298(5-6):463-572, Urban & Fischer Verlag, Germany (Jul. 2008 ).

Talwalkar, A., and Kailasapathy, K., "Effect of Microencapsulation on Oxygen Toxicity in Probiotic Bacteria," Australian Journal of Dairy Technology, 58(1):36-39, Australian Society of Dairy Technology, Australia (2003).

Tamir, H., and Gilvarg, C., "Density Gradient Centrifugation for the Separation of Sporulating Forms of Bacteria," The Journal of Biological Chemistry, 241(5):1085-1090, American Society for Biochemistry and Molecular Biology, United States (Mar. 1966).

Tanaka, M. et al., "Increased Fasting Plasma Ghrelin Levels in Patients With Bulimia Nervosa," European Journal of Endocrinology, 146(6):R1-3, BioScientifica Ltd, England (Jun. 2002).

Taur et al., "The effects of intestinal tract bacterial diversity on mortality following allogeneic hematopoietic stem cell transplantation," Blood 124(7): 1174-1182 (2014).

Taur, Y., and Pamer, E.G., "Harnessing Microbiota to Kill a Pathogen: Fixing the Microbiota to Treat Clostridium Difficile Infections," Nature Medicine, 20(3):246-247, Nature Publishing Company, United States (Mar. 2014).

Taur, Y., et al., "Intestinal Domination and the Risk of Bacteremia in Patients Undergoing Allogeneic Hematopoietic Stem Cell Transplantation," Clinical Infectious Diseases : an Official Publication of the Infectious Diseases Society of America, 55(7):905-914, Oxford University Press, United States (Oct. 2012).

Technical Data, HiMedia Laboratories Pvt. Ltd., M581 BP, 2011, pp. 1-2.

The Human Microbiome Project Consortium., "Structure, Function and Diversity of the Healthy Human Microbiome," Nature 2013, vol. 486(7402), pp. 207-214.

The Oxford Dictionary of Biochemistry and Molecular Biology, Revised Edition, Oxford University Press, England, 2 pages. (2000).

Theriot, C.M. et al., "Antibiotic-induced Shifts in the Mouse Gut Microbiome and Metabolome Increase Susceptibility to Clostridium Difficile Infection," Nature Communications, 5:3114, Nature Publishing Group, England (Jan. 2014).

Thomas, C., et al., "Targeting Bile-acid Signalling for Metabolic Diseases," Nature Reviews. Drug Discovery 7(8):678-693, Nature Pub. Group, England (Aug. 2008).

Thompson-Chagoyan, O.C., et al., "Aetiology of Inflammatory Bowel Disease (IBD): Role of Intestinal Microbiota and Gut-associated Lymphoid Tissue Immune Response," Clinical Nutrition, 24(3):339-352, Elsevier,England (Feb. 2005).

Tisa, L.S., et al., "Wet and Dry Bacterial Spore Densities Determined by Buoyant Sedimentation," Applied and Environmental Microbiology, 43(6):1307-1310, American Society for Microbiology, United States (Jun. 1982).

Tolstoshev, P., "Gene Therapy, Concepts, Current Trials and Future Directions," Annual Review of Pharmacology and Toxicology 33:573-596, Annual Reviews, United States (1993).

Trends in Biotechnology, TIBTECH 11(5): 155-215 (1993) (Table of Contents).

Turnbaugh, P.J.,et al., "A Core Gut Microbiome in Obese and Lean Twins.," Nature, 457(7228):480-484, Nature Publishing Group, England, (Jan. 2009).

Tvede, M, and Rask-Madsen, J., "Bacteriotherapy for Chronic Relapsing Clostridium Difficile Diarrhoea in Six Patients," Lancet 1(8648):1156-1160, Elsevier, England (May 1989).

Ubeda, C., et al., "Intestinal Microbiota Containing *Barnesiella* Species Cures Vancomycin-resistant Enterococcus Faecium Colonization," Infection and Immunity, 81(3):965-973, American Society for Microbiology, United States (Mar. 2013).

Ubeda, C., et al., "Vancomycin-resistant Enterococcus Domination of Intestinal Microbiota Is Enabled by Antibiotic Treatment in Mice and Precedes Bloodstream Invasion in Humans," The Journal of Clinical Investigation, 120(12):4332-4341, American Society for Clinical Investigation, United States (Dec. 2010).

Vandenplas, Y. et al., "Fecal Microbial Transplantation in Early-onset Colitis: Caution Advised," Journal of Pediatric Gastroenterology and Nutrition, 61(3):e12-4, Lippincott Williams & Wilkins, United States (Sep. 2015).

Van Der Woude, M.W., and Baumler, A.J., "Phase and Antigenic Variation in Bacteria," Clinical Microbiology Reviews, 17(3):581-611, American Society for Microbiology, United States (Jul. 2004).

Van Immerseel, F., et al., "Butyric Acid-Producing Anaerobic Bacteria as a Novel Probiotic Treatment Approach for Inflammatory Bowel Disease," Medical Microbiology 59(Pt 2):141-143, Microbiology Society, England (Feb. 2010).

Van Kregten, E., et al., "New, Simple Medium for Selective Recovery of Klebsiella Pneumoniae and Klebsiella Oxytoca From Human Feces," The Journal of Clinical Microbiology, 20(5):936-941, American Society for Microbiology, United States (Nov. 1984).

Van Nood, E., et al., "Duodenal Infusion of Donor Feces for Recurrent Clostridium Difficile," The New England Journal of Medicine 368(5):407-415, Massachusetts Medical Society, United States (Jan. 2013).

Vidal, M., et al., "Probiotics and Intestinal Colonization by Vancomycin-resistant Enterococci in Mice and Humans," The Journal of Clinical Microbiology, 48(7):2595-2598, American Society for Microbiology, United States (Jul. 2010).

(56) References Cited

OTHER PUBLICATIONS

Vigorito et al., "Evaluation of NIH consensus criteria for classification of late acute and chronic GVHD," Blood 114(3):702-708 (2009).

Villano, S.A., et al., "Evaluation of an Oral Suspension of VP20621, Spores of Nontoxigenic Clostridium Difficile Strain M3, in Healthy Subjects," Antimicrobial Agents and Chemotherapy, 56(10):5224-5229, American Society for Microbiology, United States (Oct. 2012).

Vogt et al. "Chemical communication in the gut: Effects of microbiota-generated metabolites on gastrointestinal bacterial pathogens," Anaerobe 34 106-115, Elsevier, Netherlands (2015).

Vossen et al., "Complete Suppression of the Gut Microbiome Prevents Acute Graft-Versus Host Disease following Allogeneic Bone Marrow Transplantation," PLoS One 9(9):e105706 (2014).

Wachsman, J.T., et al., "Characterization of an Orotic Acid Fermenting Bacterium, *Zymobacterium oroticum*, Nov. Gen., Nov. Spec," Bacteriology 68(4):400-404, American Society for Microbiology, United States (Oct. 1954).

Wagman, J., and Weneck, E.J., "Preservation of Bacteria by Circulating-gas Freeze Drying," Applied Microbiology, 11:244-248, American Society for Microbiology, United States (May 1963).

Waites, W.M., and Wyatt, L.R., "Germination of Spores of Clostridium Bifermentans by Certain Amino Acids, Lactate and Pyruvate in the Presence of Sodium or Potassium Ions," Journal of General Microbiology, 67(2):215-222, Society for General Microbiology, England (Aug. 1971).

Waites, W.M., and Wyatt, L.R., "The Effect of pH, Germinants and Temperature on the Germination of Spores of Clostridium Bifermentans," Journal of General Microbiology, 80(1):253-258, Society for General Microbiology, England (Jan. 1974).

Walker, A.W., and Lawley, T.D., "Therapeutic Modulation of Intestinal Dysbiosis," Pharmacological Research, 69(1):75-86, Elsevier, Netherlands (Mar. 2013).

Wang, M., et al., "Comparison of Bacterial Diversity Along the Human Intestinal Tract by Direct Cloning and Sequencing of 16S rRNA Genes," FEMS Microbiology Ecology, 54(2):219-231, Oxford University Press, England (Oct. 2005).

Wang, Q., et al., "Naive Bayesian Classifier for Rapid Assignment of Rrna Sequences Into the New Bacterial Taxonomy," Applied and Environmental Microbiology 73(16):5261-5267, American Society for Microbiology, United States (Aug. 2007).

Wang, S., and Curtiss Ill, R., "Development of *Streptococcus pneumoniae* Vaccines Using Live Vectors," Vaccines, 2(1):49-88, MDPI AG, Switzerland (Jan. 2014).

Warren, Y.A., et al., "*Clostridium aldenense* Sp. Nov. and *Clostridium citroniae* Sp. Nov. Isolated from human clinical Infections," Journal of Clinical Microbiology 44(7):2416-2422, American Society for Microbiology, United States (Jul. 2006 ).

Weber et al., "Low urinary indoxyl sulfate levels early after transplantation reflect a disrupted microbiome and are associated with poor outcome," Blood 126(14): 1723-1728 -2015.

Weingarden, A.R., et al., "Microbiota Transplantation Restores Normal Fecal Bile Acid Composition in Recurrent Clostridium Difficile Infection," American Journal of Physiology. Gastrointestinal and Liver Physiology, 306(4):G310-319, American Physiological Society, United States (Feb. 2014).

Wells, C.L. et al., Chapter 18: Clostridia: Sporeforming Anaerobic Bacilli, Medical Microbiology, 4th Edition, 1996, pp. 1-20.

Wells, J.E and Hylemon, P.B., "Identification and Characterization of a Bile Acid 7alpha-dehydroxylation Operon in *Clostridium* Sp. Strain to-931, a Highly Active 7alpha-dehydroxylating Strain Isolated From Human Feces.," Applied and Environmental Microbiology, 66(3):1107-1113, American Society for Microbiology,United States, (Mar. 2000).

Wells, J.E.,et al., "Development and Application of a Polymerase Chain Reaction Assay for the Detection and Enumeration of Bile Acid 7alpha-dehydroxylating Bacteria in Human Feces.," Clinica chimica acta; international journal of clinical chemistry, 331(1-2):127-134, Elsevier,Netherlands, (May 2003).

Wiencek, K.M. et al., "Hydrophobicity of Bacillus and Clostridium Spores," Applied and Environmental Microbiology, 56(9):2600-2605, American Society for Microbiology, United States (Sep. 1990).

Wilson, K.H and Freter, R, "Interaction of Clostridium Difficile and *Escherichia coli* With Microfloras in Continuous-flow Cultures and Gnotobiotic Mice," Infection and Immunity, 54(2):354-358, American Society For Microbiology, United States (Nov. 1986).

Wilson, K.H., et al., "Role of Competition for Nutrients in Suppression of Clostridium Difficile by the Colonic Microflora," Infection and Immunity, 56(10):2610-2614, American Society for Microbiology, United States (Oct. 1988).

Wilson, K.H., et al., "Suppression of Clostridium difficile by Normal Hamster Cecal Flora and Prevention of Antibiotic-Associated Cecitis," Infection and Immunity, 34(2):626-628, American Society for Microbiology, United States (Nov. 1981).

Wilson, K.H., Sheagren, J.N., "Antagonism of Toxigenic Clostridium Difficile by Nontoxigenic C. Difficile," The Journal of Infectious Diseases, 147(4):733-736, Oxford University Press, England (Apr. 1983).

Wingender, G., et al., "Intestinal Microbes Affect Phenotypes and Functions of Invariant Natural Killer T Cells in Mice," Gastroenterology, 143(2):418-428, PA : W.B. Saunders,United States, (Aug. 2012).

Woo, T.D., et al., "Inhibition of the Cytotoxic Effect of Clostridium Difficile in Vitro by Clostridium Butyricum Miyairi 588 Strain," Journal of Medical Microbiology, 60(Pt 11):1617-1625, Microbiology Society, England (Nov. 2011).

Wood et al., "Kraken: ultrafast metagenomic sequence classification usmg exact alignments," Genome Biology 15:R46 (2014).

Wortman, J. R., et al., "Design and evaluation of SER-262: A fermentation-derived microbiometherapeutic for the prevention of recurrence in patients with primary clostridium difficile infection," Seres Therapeutics, Cambridge, MA, Jun. 1, 2016, Retrived from (http://serestherapeutics.com/sites/default/files/wortman_asm_poster_final_poster_ser_262.pdf), Retrieved on [Mar. 6, 2017], 1 page.

Wrobel, B., "Statistical Measures of Uncertainty for Branches in Phylogenetic Trees Inferred From Molecular Sequences by Using Model-based Methods," Journal of Applied Genetics, 49(1):49-67, Springer, England (2008).

Wroblewski, D., et al., "Rapid Molecular Characterization of Clostridium Difficile and Assessment of Populations of C. Difficile in Stool Specimens," Journal of Clinical Microbiology, 47(7):2142-2148, American Society for Microbiology, United States (Jul. 2009).

Wu, G.Y. and Wu, C.H., "Delivery Systems for Gene Therapy," Biotherapy 3(1):87-95, Kluwer Academic Publishers, Netherlands (1991).

Yamakawa, K., et al., "Enhancement of Clostridium Difficile Toxin Production in Biotin-limited Conditions," Journal of Medical Microbiology, 44(2):111-114, Microbiology Society, England (Feb. 1996).

Yamamura, H., et al., "Application of Sucrose-gradient Centrifugation for Selective Isolation of *Nocardia* Spp. From Soil," Journal of Applied Microbiology, 95(4):677-678, Published for the Society for Applied Bacteriology by Blackwell Science, England (2003).

Yang, W.W. (201 0). Fast Viability Assessment of Clostridium Spores Survival in Extreme Environments. PhD thesis California Institute of Technology.

Yang, W.W., et al., "Production and Characterization of Pure Clostridium Spore Suspensions," Journal of Applied Microbiology, 106(1):27-33, Published for the Society for Applied Bacteriology by Blackwell Science, England (Jan. 2009).

Yang, W.W., Ponce, A., "Validation of a Clostridium Endospore Viability Assay and Analysis of Greenland Ices and Atacama Desert Soils," Applied and Environmental Microbiology, 77(7):2352-2358, American Society for Microbiology, United States (Jan. 2011).

Yen et al., "IL-23 is essential for T cell-mediated colitis and promotes inflammation via IL-17 and IL-6," The J oumal of Clinical Investigation 116( 5): 1310-1316 (2006).

Yi, Y., et al., "Current Advances in Retroviral Gene Therapy," Current Gene Therapy 11(3):218-228, Bentham Science Publishers, Netherlands (2011).

(56) References Cited

OTHER PUBLICATIONS

Yl, X., and Setlow, P., "Studies of the Commitment Step in the Germination of Spores of Bacillus Species," Journal of Bacteriology, 192(13):3424-3433, American Society for Microbiology, United States (Jul. 2010).

Yuguchi Hiroya et al., "Hakkonyuu/nyuusankin inryou to chounaikinsou Fermented Milk/Lactic Acid Bacteria Beverages and Intestinal Bacterial Flora," New Food Industry, 29(7):71-88 (1987).

Yung, P.T., and Ponce, A., "Fast Sterility Assessment by Germinable-Endospore Biodosimetry," Applied and Environmental Microbiology, 74(24):7669-7674, American Society for Microbiology, United States (Sep. 2008).

Yunoki, M., et al., "Heat Sensitivity of Human Parvovirus B19," Vox Sanguinis, 84(3):164-169, Blackwell Science, England (Apr. 2003).

Yutin, N. and Galperin, M.Y., "A Genomic Update on Clostridial Phylogeny: Gram-negative Spore Formers and Other Misplaced Clostridia," Environmental Microbiology 15(10):2631-2641, Blackwell Science, England (Oct. 2013).

Zar, F.A., "A Comparison of Vancomycin and Metronidazole for the Treatment of Clostridium Difficile-associated Diarrhea, Stratified by Disease Severity.," Clinical Infectious Diseases : an Official Publication of the Infectious Diseases Society of America, 45(3):302-307, Oxford University Press, United States, (Aug. 2007).

Ze, X., et al., "Ruminococcus Bromii Is a Keystone Species for the Degradation of Resistant Starch in the Human Colon,"The ISME Journal, 6(8):1535-1543, Nature Publishing Group, England (Aug. 2012).

Zeng, Y., et al., "Towards Development of Stable Formulations of a Live Attenuated Bacterial Vaccine: a Preformulation Study Facilitated by a Biophysical Approach," Human Vaccines, 5(5):322-331, Landes Bioscience, United States (May 2009).

Zhao, J., et al., "Evaluation of Endospore Purification Methods Applied to Bacillus Cereus," Separation and Purification Technology, 61(3):341-347, Elsevier Ltd, Netherlands (Jul. 2008).

Zhao, Y., et al., "Rapsearch2: a Fast and Memory-efficient Protein Similarity Search Tool for Next-generation Sequencing Data.," Bioinformatics (Oxford, England), 28(1):125-126, Oxford University Press,England, (Jan. 2012).

Zhou, D., et al., "Total Fecal Microbiota Transplantation Alleviates Highfat Diet-Induced Steatohepatitis in Mice via Beneficial Regulation of Gut Microbiota," Scientific Reports 7(1):11 pages, Nature Publishing Group, England (May 2017).

Zhu, C., et al., "Bile Acids in Regulation of Inflammation and Immunity: Friend or Foe?," Clinical and Experimental Rheumatology 34(4 Suppl 98):25-31, Clinical And Experimental Rheumatology S.A.S, Italy (Jul.-Aug. 2016).

Zilberberg, M.D.,et al., "Increase in Adult Clostridium Difficile-related Hospitalizations and Case-fatality Rate, United States, 2000-2005.," Emerging Infectious Diseases, 14(6):929-931, National Center for Infectious Diseases, Centers for Disease Control and Prevention (CDC),United States., (Jun. 2008).

Hickson, M., et al., "Use of probiotic Lactobacillus preparation to prevent diarrhoea associated with antibiotics: randomised double blind placebo controlled trial," BMJ 335(7610):80, 5 pages, British Medical Association, United Kingdom (Jul. 2007).

Maziade, P.-J., et al., "Impact of adding prophylactic probiotics to a bundle of standard preventative measures for Clostridium difficile infections: enhanced and sustained decrease in the incidence and severity of infection at a community hospital," Curr Med Res Opin 29(10):1341-1347, Taylor & Francis, United Kingdom (2013).

Schoefer, L., et al., "Anaerobic degradation of flavonoids by Clostridium orbiscindens," Appl Environ Microbiol 69(10):5849-5854, American Society of Microbiology, United States (Oct. 2003).

Spinler, J. K., et al., "Probiotics as adjunctive therapy for preventing Clostridium difficile infection—What are we waiting for?," Anaerobe 41:51-57, Elsevier, Netherlands (Oct. 2016).

Winter, J., et al., "*Clostridium orbiscindens* Sp. Nov., A Human Intestinal Bacterium Capable of Cleaving the Flavonoid C-Ring," International Journal of Systematic Bacteriology, 41(3):355-357, Society for General Microbiology, England (1991).

\* cited by examiner

† cited by third party

|  | BSH | | | | | 7α-HSDH | | 3α-HSDH | | 12α-HSDH | | 7α-De-OH | |
|---|---|---|---|---|---|---|---|---|---|---|---|---|---|
|  | gCA | gCDCA | tCA | tCDCA | tMCA | CA | CDCA | CA | CDCA | CA | DCA | CA | CDCA |
| Bacteroides faecis |  |  |  |  |  | ■ | ■ |  |  |  |  |  |  |
| Bacteroides sp_3_1_23 | ■ | ■ | ■ | ■ | ■ | ■ |  |  |  |  |  |  |  |
| Bacteroides stercoris |  |  |  |  |  |  |  |  |  |  |  |  |  |
| Bacteroides uniformis |  |  | ■ | ■ | ■ |  |  |  |  |  |  |  |  |
| Bacteroides vulgatus |  |  | ■ | ■ | ■ |  |  |  |  |  |  |  |  |
| Blautia wexlerae |  | ■ | ■ | ■ | ■ |  |  |  |  |  |  |  |  |
| Clostridium ghonii | ■ | ■ | ■ | ■ | ■ | ■ | ■ |  |  |  |  | ■ | ■ |
| Clostridium nexile |  |  |  |  |  |  |  |  |  |  |  |  |  |
| Clostridium symbiosum | ■ |  | ■ | ■ | ■ | ■ |  |  | ■ |  |  |  |  |
| Clostridium hylemonae 1 |  |  |  |  |  |  |  |  |  |  |  |  |  |
| Clostridium hylemonae 2 |  |  |  |  |  | ■ |  | ■ |  |  | ■ |  | ■ |
| Eubacterium limosum | ■ | ■ | ■ | ■ | ■ |  |  |  |  |  |  |  |  |
| Lachnospiraceae Bacterium_5_1_57FAA 1 |  |  |  |  |  |  |  |  | ■ |  | ■ |  | ■ |
| Lachnospiraceae Bacterium_5_1_57FAA 2 |  |  |  |  |  | ■ |  |  |  |  |  |  |  |
| Parabacteroides distasonis | ■ | ■ | ■ |  |  |  |  |  |  |  |  |  |  |
| Parabacteroides merdae |  |  |  |  |  |  |  |  |  |  |  |  |  |
| Roseburia faecalis | ■ |  | ■ |  |  |  |  |  |  |  |  | ■ |  |
| Ruminococcus lactaris |  | ■ | ■ | ■ |  |  |  |  |  |  |  |  |  |
| Ruminococcus bromii |  |  |  |  |  |  |  |  |  | ■ |  |  |  |

**** P < 0.0001 vs. Germ-Free

A.

B.

C.

D.

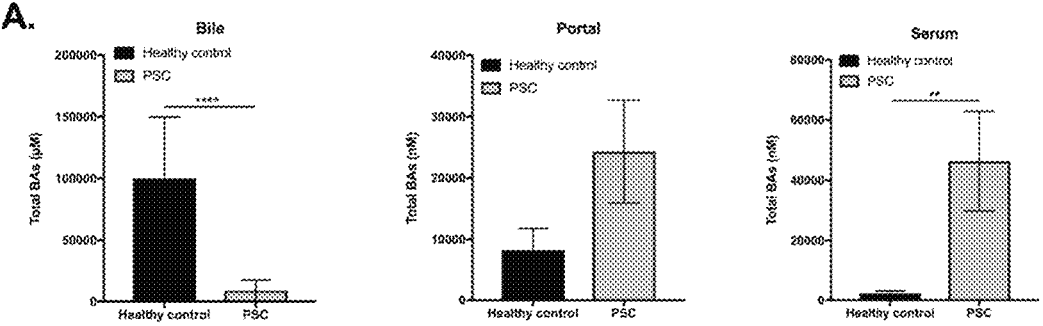
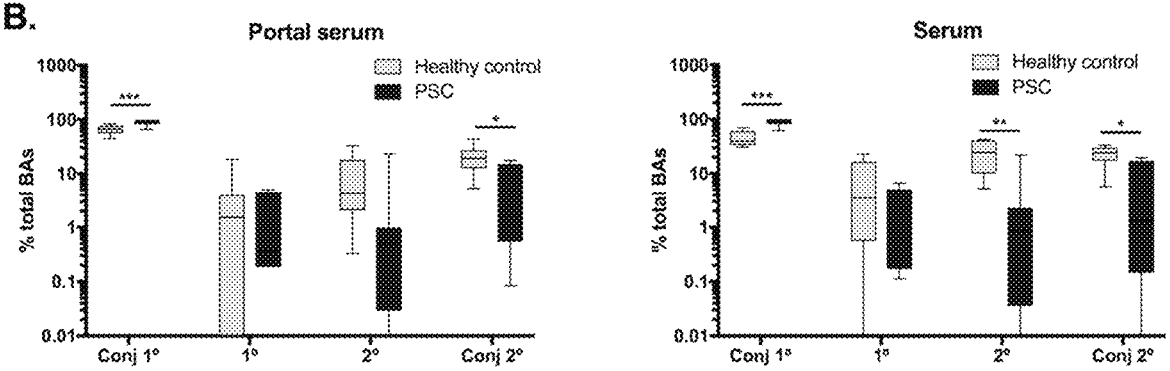
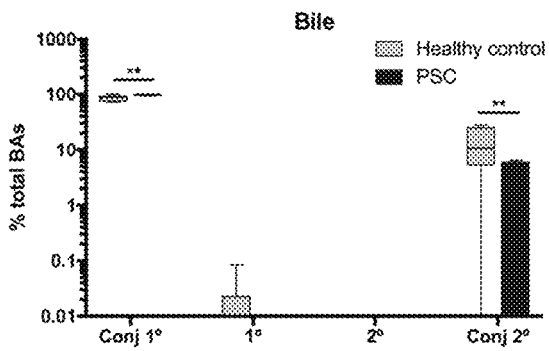
FIGs. 8A and 8B

FIG. 9E

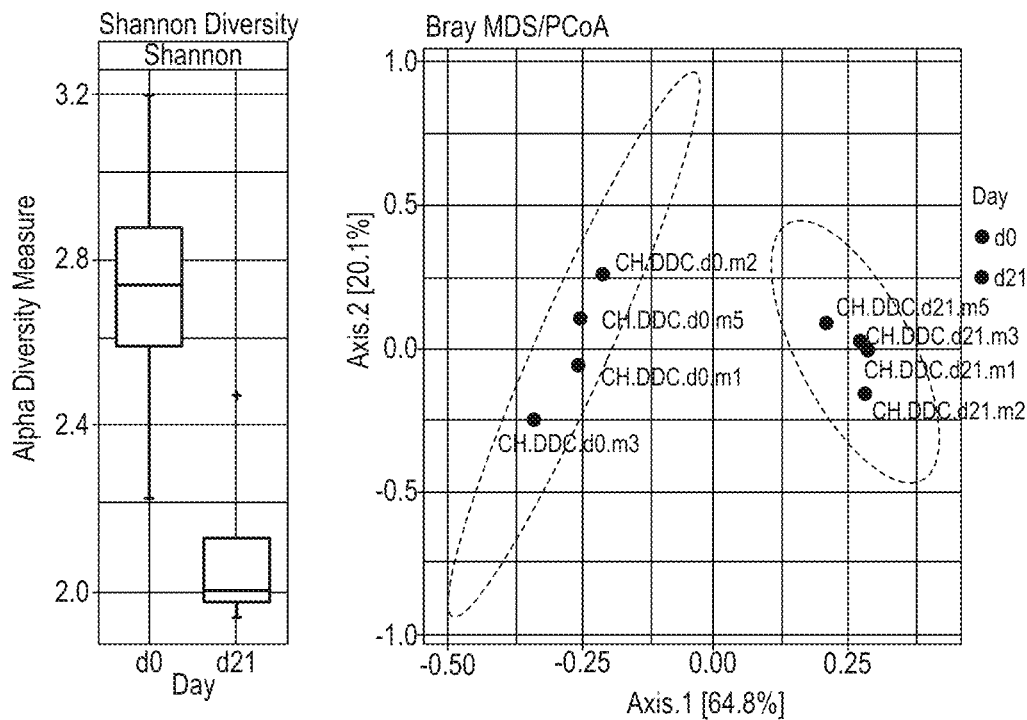

FIG. 9F

| Species | Prevalence - d0 (healthy) | Prevalence - d21 (cholestatic disease) | p-value |
|---|---|---|---|
| Bacteroides_pectinophilus | 0 | 1 | 0.028 |
| Clostridium_citroniae | 0 | 1 | 0.028 |
| Coprobacillus_sp_29_1 | 0 | 1 | 0.028 |
| Enterococcus_faecium | 0 | 1 | 0.028 |
| Staphylococcus_sciuri | 0 | 1 | 0.028 |
| Turicibacter_sanguinis | 0 | 1 | 0.028 |
| Acetanaerobacterium_elongatum | 0.25 | 1 | 0.142 |
| Clostridium_disporicum | 0.25 | 1 | 0.142 |
| Clostridium_sordellii | 0.25 | 1 | 0.142 |
| Proteus_mirabilis | 0.25 | 1 | 0.142 |
| Clostridium_sartagoforme | 0 | 0.75 | 0.142 |
| Enterococcus_faecalis | 0 | 0.75 | 0.142 |
| Lactococcus_lactis | 0 | 0.75 | 0.142 |
| Staphylococcus_fleurettii | 0 | 0.75 | 0.142 |
| Papillibacter_cinnamivorans | 1 | 0 | 0.028 |
| Roseburia_faecalis | 1 | 0 | 0.028 |
| Blautia_luti | 1 | 0.25 | 0.142 |
| Clostridium_oroticum | 1 | 0.25 | 0.142 |
| Clostridium_sp_YIT_12070 | 1 | 0.25 | 0.142 |
| Dorea_longicatena | 1 | 0.25 | 0.142 |
| Eubacterium_siraeum | 1 | 0.25 | 0.142 |
| Clostridium_aerotolerans | 0.75 | 0 | 0.142 |

FIG. 16A

| refOTU | SPECIES | NCBI CODE | SEQ ID | SEQUENCE |
|---|---|---|---|---|
| Abiotrophia_defectiva_ATCC_49176_NCBI_ACIN02000016 | Abiotrophia_defectiva | ACIN02000016 | SEQ ID NO: 1 | ATGAGAGTTTGATCCTGGCTCAGGATGAACGCTGGCGGCGTGCCTAACACATGCAAGTCGAACGGAGATTACGGACGG AAGTTTCGGATGGAAGCCTGTAATTCTTAGTGGCGAACGGGTGAGTAACGCGTGAGGAACCTGCCTTATACAGGGGG ATAGCAGCTGGAAACGGCTGCTAATACCGGATAAGTCGGTTAAATCGCATGATTTGATCGGAAAATGAGCAATCAGGTA TAGGATGGGCCCGCGTCGATTAGCTAGTTGGTGGGGTAAAAGCCTACCAAGGCGACGATCGGTAGCCGGACTGAGAG GTCGGACGGCCACATTGGGACTGAGACACGGCCCAAACTCCTACGGGAGGCAGCAGTAGGGAATATTGCACAATGGA GGAAACTCTGATGCAGCGACGCCGCGTGAGTGAAGAAGGTATTTCGGTATGTAAAGCTCTATCAGCAGGGAAGATGATGA CGGTACCTGACTAAGAAGCCCCGGCTAACTACGTGCCAGCAGCCGCGGTAATACGTAGGGGCAAGCGTTATCCGGAT TTACTGGGTGTAAAGGGGCGTTGGCAAGTTGAGAGCAGGGCTCAACCCCTGCTCCGCTCCCCAAACTGCTAAAACTTGAGTAGTGGAGAGGTAGCGGAATTCCTAGTGTAGCGGTGAAATGCGTAGATATTAGAATGTGCAAAGAAC ACCGGTGGCGAAGGCGGCCTTCTGGACCAACACTGACGCTGAGGCTCGAAAGCGTGGGTAGCAACAGGATTAGATAC CCTGGTAGTCCACGCCGTAAACGATGAATACTAGGTGTCTGGGAGTGCATAAGCATTCGGTGCCGTCGCAAACGCATTAA GTATTCCACCTGGGGAGTACGCACGCAAGAGTGAAACTCAAAGGAATTGACGGGACCCCACAAGCGGTGGAGCATG TGGTTTAATTCGACGCAACGCGAAGAACCTTACCCGGTCTTGACATCCCGTGTAGCTCTAAGAGATACGGGAGTCCTTC GGGACAGCGGTGACAGGTGGTGCATGGTTGTCGTCAGCTCGTGTCGTGAGATGTTGGGTTAAGTCCCGCAACGAGCGC AACCCCTATTTTAGTAGCCAGCGGTTCGGCCGGACTCTAAAGACTGCCGGTGATAAACCGGAGGAAGGTGGGGATG ATGACGTCAAATCATCATGCCCCTTATGACCCGGGCTACACACGTGCTACAATGGTTAGTACAACGGGTTGCAAAGCTGCAAGCGGAAGCTAATCTCAGAAAAGCTAATCTCAGTTCGGATTGGAGTCTGCAACTCGACTCCATGAAGTCGGAATCGCTAGTAATCGCGAATCAGAATGTCGCGGTGAATACGTTCCCGGGTCTTGTACACCACGCCCGTCACACCATGGGAGTCGGGAGCAAAGTCGCGAAGGT TAAGGTGATCAGTGCCGAAGGTGCGGCTGGATTAAGGGGTATGCGTATCGAAGGTGCGGCTGGATCACCTCCTTTCT |
| Abiotrophia_sp_oral_clone_P4PA_155_P1_NCBI_AY207063 | Abiotrophia_sp_oral_clone_P4PA | AY207063 | SEQ ID NO: 2 | GACGAACGCTGGCGGCGTGTGCCTAATACATGCAAGTCGAACGAGTGGCGAACGGGTGAGTAACACGTGGGTAACCTACC TCATAGTGGGGGATAACAGTTGGAAACGACTGCTAATACCGCGATAATACCGAAAAGTCGCTAAGAGATGACCCGCGGTGCA TTAGCTAGTTGGTAGGGTAAGGGCCTACCAAGGCGATGATGCATAGCCGAGCTGAGAGGTTGATCGGCCACATTGGGA CTGAGACACGGCCCAGACTCCTACGGGAGGCAGCAGTAGGGAATCTTCCGCAATGGACGAAAGTCTGACGGAGCAACG CCGCGTGAGCGATGAAGGTCTTCGGATCGTAAAGCTCTGTTGTTGAAGAAGAACGTGTGTGAGAGTAAGCCACGG CTAACTACGTGCCAGCAGCCGCGGTAATACGTAGGTGGCAAGCGTTGTCCGGATTTATTGGGCGTAAAGGGAGCGTAG GCGGTCTTTAAGTCTGATGTGAAAGCCCACGGCTCAACCGTGGAGGGCCATTGGAAACTGGAAGACTTGAGTGCAGAA GAGGAGAGTGGAATTCCATGTGTAGCGGTGAAATGCGTAGATATACCAGGAGGAACACCAGTGGCGAAAGCGGCTCTCTG GTCTGACTGACGCTGAGGCTCGAAAGCGTGGGTAGCAACAGGATTAGATACCCTGGTAGTCCACGCCGTAAACGATGAA AGTGCTAAGTGTGGGGGGTCTTCCTTGGACGAGAGCCTGCTAAAGCATTAAGCACTCCGCCTGGGGAGTACGACCGCAAGGTT GAAACTCAAAGGAATTGACGGGGACCCGCACAAGCGGTGGAGCATGTGGTTTAATTCGAAGCAACGCGAAGAACCTTACCA GGTCTTGACATCCTATAACTAGTTGCCAGAGATGGCTTGTGCCGGTGCAATACGCCGAATGTCAAGTCCGGCATGGATCG CAAATCATCATGCCCCTTATGACCTGGGCTACACACGTGCTACAATGGATGGTACAACGAGTCGCAAGACCGCGAGGT GGAGCTAATCTCATAAAACCATTCTCAGTTCGGATTGCAGGCTGCAACTCGCCTGCATGAAGTCGGAATCGCTAGTAATCG CGGATCAGCACGCCGCGGTGAATACGTTCCCGGGCCTTGTACACACCGCCCGTCACACCACGAGAGTTAGCCGTATCGGAAGGT GGTGCCCTAGGAGCCGTCGAAGGTGGGATAGATGATTGGGGTGAAGTCGTAACAAGGTAGCCGTATCGGAAGGT |
| Aerococcus_sanguinicola_NCBI_AY837833 | Aerococcus_sanguinicola | AY837833 | SEQ ID NO: 3 | CTCAGGACGAACGCTGGCGGCGTGCCTAATACATGCAAGTCGAGCGAACGGACGAAGTGCTTGCACTTCTGACGTTAG TGGCGGACGGGTGAGTAACACGTGAGTAACCTATGCGGAGGGGACAACATCCGGGAAACGGATGCTAATACCGCA TAGTAATTTGTCAGGCATCTGCTGACAAATTGGAAAGACGCTTTTGCTGTCACTTGTAAGATGGTCTGCGGTCTATTAGCTA |

FIG. 16B

| | | | |
|---|---|---|---|
| | | | GTTGGGTGGGATAAAAGCTTACCAAGGCCATGATGCATAGCGACCTGAGAGGGTAATCGGCCACACTGGGACTGAGAC ACGGCCCAGACTCCTACGGGAGGCAGCAGTAGGGAATCTTCCGCAATGGACGAAAGTCTGACGGAGCAATGCCGCGT GAGTGAAGAAGGGTTTTCGGATCGGTAAAACTCTGTTGCCAGCAGCCGCGGTAATACGTAGGTGGCAAGCGTTGTCCGGAATTTAT TATCTGGGCGTAAAGCGAGCGCAGGCGGTTCTTAAGTCTGATGTGAAAGCCCACGGCTCAACCGTGGAGGGTCATTGGAAA CTGGGAGACTTGAGTGCAGAAGAGGAGAGTGGAATTCCATGTGTAGCGGTGAAATGCGTAGATATATGGAAGAACACCA GTGGCGAAGGCGACTCTCTGGTCTGTAAACTGACGCTGAGGCTCGAAAGCGTGGGGAGCAAACAGGATTAGATACCCTG GTAGTCCACGCCGTAAACGATGAGTGCTAAGTGTTGGAGGGTTTCCGCCCTTCAGTGCTGCAGCTAACGCATTAAGCAC TCCGCCTGGGGAGTACGACCGCAAGGTTGAAACTCAAAGGAATTGACGGGGGCCCGCACAAGCGGTGGAGCATGTGG TTTAATTCGAAGCAACGCGAAGAACCTTACCAAGTCTTGACATCCTTTGACCAATCCTAGAGATAGGGTAAGTCCCTTCGGG GACAAAGTGACAGGTGGTGCATGGTTGTCGTCAGCTCGTGTCGTGAGATGTTGGGTTAAGTCCCGCAACGAGCGCAAC CCTTATTGTTAGTTGCCAGCATTAGTTGGGCACTCTAGCGAGACTGCCGGTGACAAACCGGAGGAAGGCGGGGATGA CGTCAAATCATCATGCCCCTTATGACTTGGGCTACACACGTGCTACAATGGATGGTACAACGAGTCGCGAACTCGCGAG AGTCAAGCTAATCTCTTAAAGCCATTCTCAGTTCGGATTGTAGGCTGCAACTCGCCTACATGAAGCCGGAATCGCTAGTA ATCGCGGATCAGCATGCCGCGGTGAATACGTTCCCGGGCCTTGTACACACCGCCCGTCACACCATGAGAGTTTGTAAC ACCCGAAGTCGGTGAGGTAACCTTTGGAGCAACCGCCTAAGGTGGGATAGATGATTGGGGGTGAAGTCGTAACAA | |
| Aerococcus_urinae_ ACS_120_V_Col10a _NCBI_CP002512 | Aerococcus_urina e | CP002512 | SEQ ID NO: 4 | ATGAGAGAGTTTGATCCTGGCTCAGGACGAACGCTGGCGGCGTGCCTAATACATGCAAGTCGAGCGAACCGAAGAAGTGC TTGCACTTCTGACGTTAGCGACGGAATACCGCAGTAACACGTGAGTAACGCTAAGGAACGTACCGATAAGCAACATCCGGAA ACGGGTGCTAATACCGGATAAGGAAAACACCACCTCATGTGGTGTTGGAAAAGACGGCTTTGCGTCGACCTTATCGATGGC CTTGCGGTGATCAGTAGCTGGTGGTTGGGTAACGGCCCACCAAGCCAAACGATGATCATAGCCGACCTGAGAGGGTAATCGG CCACATTGGGACTGAGACACGGCCCAAACTCCTACGGGAGGCAGCAGTAGGGAATCTTCCGCAATGGACGAAAGTCTGAC GGAGCAACGCCGCGTGAGTGAAGAAGGGTTTCGGCTCGTAAAGCTCTGTTGTTTAAAGAAGAACAAATTTGGAGAGTAA CTGCTCCAGTGTCCGACGGTATCTTACCAGAAGCCACGGCTAACTACGTGCCAGCAGCCGCGGTAATACGTAGGTGGCA AGCGTTGTCCGGAATTATTGGGCGTAAAGCGGTGAGCGCAGGCGGTTTCTTAAGTCTGATGTGAAAGCCACGCGCTTAACCG TGGAAGTGCATTGGAAACTTGGAGACTTGAGTGCAGAAGAGGAGAGTGGAATTCCATGTGTAGCGGTGAAATGCGTAG ATATATGGAAGAACACCAGTGGCGAAGGCGGCTCTCTGGTCTGTCACTGACGCTGAGGCTCGAAAGCGTGGGTAGCAA ACAGGATTAGATACCCTGGTAGTCCACGCCGTAAACGATGAGTGCTAAGTGTTGGAGGGTTTCCGCCCTTCAGTGCCGG AGTTAACGCATTAAGCACTCCGCCTGGGGAGTACGACCGCAAGGTTGAAACTCAAAGGAATTGACGGGGACCCGCACA AGCGGTGGAGCATGTGGTTTAATTCGAAGCAACGCGAAGAACCTTACCAAGTCTTGACATCCTTTGACCGCTCTAGAGAT AGAGCTTTCCCTTCGGGGACAGAATGACAGGTGGTGCATGGTTGTCGTCAGCTCGTGTCGTGAGATGTTGGGTTAAGTC CCGCAACGAGCGCAACCCTTATTGTTAGTTGCCAGCATTCAGTTGGGCACTCTAGCGAGACTGCCGGTGACAAACCGGA GGAAGGCGGGGATGACGTCAAATCATCATGCCCCTTATGACCTGGGCTACACACGTGCTACAATGGATGGTACAACGAG CAGCGACCTTGCGAAAGCAAGCAAGATCGGAGTCCGGAATCGCTAGTAATCGCGGATCAGCATGCCGCGGTGAATACGT TCCCGGGCCTTGTACACACCGCCCGTCACACCATGGGAGTTGGCACCACCCGAAGTCGGTGAGGTAAACCTTGTACACACCGCCCGTCACACCATGAGAGTTTGTAACACCCCGAAGTCGGTGAGGTAACCTTTATGGAGCCAGCCGCCTAAGGTGGGATA GATGATTGGGGTGAAGTCGTAACAAGGTAGCCGTACCGGAAGGTGCGGCTGGATCACCTCCTTTCT | |
| Aerococcus_urinaee qui_IFO12173_NR_ 043443 | Aerococcus_urina eequi | NR_043443 | SEQ ID NO: 5 | ACATGCAAGTCGAGCGAACAGATGAAGTGCTTGACTTCTGACGTTAGCGGCGGAACGGGTGAGTAACGCGTAAGGAATC TACCTATAAGCCGGGGATAACATTCGGAAACGGATGCTAATACCGCATAATATCTTCTTCCGCATGGAAGAAGATTGAAA GACGGCTCTGCTGTCACTTATAGATGACCTTGCGGTGCATTAGCTAGTTGGTGGGCTAACGGCCTACCAAGGCGATGAT GCATAGCCGACCTGAGAGGGTGATCGGCCACATTGGGACTGAGACACGGCCCAAACTCCTACGGAGGCAGCAGTAG GGAATCTTCCGGACAATGGGCGAAAGCCTGATCCAGCCATGCCGCGTGAGTGAAGAAGGCCTTCGGGTCGTAAAACTCTG TTATAAGAGAAGAACAAATTGACGGTAGCTTAACGAGAAAGCCACGGCTAACTACGTGCCAGCAGCCGCGGTAAACTCTG CAGCAGCCGCGGTAATACGCCACGGTTCAACCGGATTTATTGGGCGTAAAGCGAGCGCAGGCGGTTCCCTAAGTCTGTGC ACTCCATGATGTGAAGCCCACGGCTCAACCGTGGAGGGTCATGGAAACTGGGGAACTTGAGTGCAGAAGAGGAGAGTGG AATTCCATGTGTAGCGGTGAAATGCGTAGATATATGGAGGAACACCAGTGGCGAAAGCGGCTCTCTGGTCTGTAACTGAC GCTGAGGCTCGAAAGCGTGGGGAGCAAACAGGATTAGATACCCTGGTAGTCCACGCCGTAAACGATGAGTGCTAGGTG TTGGAGGGTTTCCGCCCTTCAGTGCCGCAGCTAACGCATTAAGCACTCCGCCTGGGGAGTACGACCGCAAGGTTGAAA CTCAAAGGAATTGACGGGGGCCCGCACAAGCGGTGGAGCATGTGGTTTAATTCGAAGCAACGCGAAGAACCTTACCAA | |

FIG. 16C

| | | | |
|---|---|---|---|
| Aerococcus_viridans_ATCC_11563_NCBI_ADNT01000041 | Aerococcus_viridans | ADNT01000041 | SEQ ID NO: 6 | GTCTTGACATCCTCTTGACCAGTGAAGATAGGGGCTTTCCCTTGGGGACAAAGTGACAGGTGGTGCATGGTTGTCGTC<br>AGCTCGTGTCGTGAGATGTTGGGTTAAGTCCCGCAACGAGCGCAACCCCTATTATTAGTTGCCAGCATTNAGTTGGGCA<br>CTCTAATGAGAACTGCCGGTGACAAACTCGAGGAGGAAGGTGGGGATGACGTCAAATCAGCATCGCCCTTATGACCTGGGCTA<br>CACACGTGCTACAAATGGATGGTACAAACCCGCGAAGCCGCAAGCCAATCTCAGAAAGCCATTCTCAGTTCG<br>GATTGCAGGCTGCAACTCGCCTGCATGAAGCCGGAATCGCTAGTAATCGCAGATCAGCACCGCTGCGGTGAATACGTTCC<br>CGGGTCTTGTACACACCGCCCGTCACACCATGGGAGTTTGTACACCCGAAGTCGGTGAGGTAACCTTTATGGAGCCAG<br>CC |
| | | | | ATGAGAGTTTGATCCTGGCTCAGGACGAACGCTGGCGGCATGCTAATACATGCAAGTCGAGGAACAGATGAAGTGCT<br>TGCACTTCTGACGTTAGCGGCGGACGGGTGAGTAACGCGTAAGGAATCTACCCTATAAGGGGGGATAACATTCGGAAAC<br>GGGTGCTAATACCGGATAATATTTCTTCCGCATGGCTACCGAGAGATTGAAAGACGGCTCTGTGTCACTCTATAGATGACCTT<br>GCGTTGCATTAGTTAGTTGGTGGGGTAATGGCCTACCAAGACGATGATGCATAGCCGACCTGAGAGGGTGATCGGCCA<br>CATTGGGACTGAGACACGGCCCAAACTCCTACGGGAGGCAGCAGTAGGGAATCTTCCGCAATGGGCGAAAGCCTGACG<br>GAGCAATGCCGCGTGAGTGAAGAAGGCCTTCGGGTCGTAAAACTCTGTTATAAGAGAAGAACAAATTGTAGAGTAACTG<br>CTACAGTCTTGACGGTATCTTATCAGAAAGCCACGGCTAACTACGTGCCAGCAGCCGCGGTAATACGTAGGTGGCAAGC<br>GTTGTCCGGATTTATTGGGCGTAAAGCGTAAAGGCAGGAGGCAAGTGGTTTCTTAAGTCTGATGTGAAAGCCCACGGCTGG<br>AGGGTCATTGGAAACTGGGAAGTGAGTACAGAAGAGGAATGTGAACTCCATGTGTAGCGGTGGAATGCGTAGATAT<br>ATGGAAGAACACCAGTGGCGAAGGCGACATTCTGGTCTGTTACTGACACTGAGGCTCGAAAGCGTGGGGAGCAAACAG<br>GATTAGATACCCTGGTAGTCCACGCCGTAAACGATGAGTGCTAGGTGTTGGAAGGTTCCGCCTTCAGTGCCGCAGTT<br>AACGCATTAAGCACTCCGCCTGGGGAGTACGACCGCAAGGTTGAAACTCAAAGGAATTGACGGGGGCCCGCACAAGCG<br>GTGGAGCATGTGGTTTAATTCGAAGCAACGCGAAGAACCTTACCTGGTTTGACATCCTCGTCGCGGCACTGAGAGATGTCCG<br>GCTTTCCCTTCGGGGACAAAGTGACAGGTGGTGCATGGTTGTCGTCAGCTCGTGTCGTGAGATGTTGGGTTAAGTCCCG<br>CAACGAGCGCAACCCCTATTAGTTAGTTGGCACTGACACTGAGAGCGCCAACTCGGTGACAAACCGGAGA<br>AGGTGGGGATGACGTCAAATCAGCATGCCCCTTATGACCTGGGCTACACACGTGCTACAATGGATGGTACAAAGCGTTG<br>CAAACCCGCGAGGGGGAGCTAATCCGATAAAGCCATCTCAGTTCGGATTGTAGTCTGCAACTCGACACAACCGAAGCCG<br>GAATCGCTAGTAATCGTAGATCAGCACGCTACGGTGAATACGTTCCCGGGTCTTGTACACACCGCCCGTCACACCACGA<br>GAGTTTGTAACACCCGAAGTCGGTGAGGTAACCTTTATGGAGCCAGCCGCCTAAGGTGGGACAGATGATTGGGGTGAA<br>GTCGTAACAAGGTAGCCGTATCGGAAGGTGCGGCTGGATCACCTCCTTCT |
| Alistipes_finegoldii_DSM_17242_CIP_107999_NR_043064 | Alistipes_finegoldii | NR_043064 | SEQ ID NO: 7 | GATGAACGCTAGCGGCAGGCTTAACACATGCAAGTCGAGGGGCAGCAGGAAGAAACTTTGGTGGCGACCGGCG<br>CACGGGTGCGTAACGCGTATGGGTTAAGCTTTAAGCAACTGACCCTAACACTGAGAAATTGCAGCTAATTCCCATAACATT<br>CGAGAAGGCATCTCTTCGGTTAAAAACTCCGGTGGTTAAAGATGGGCATGCGTTGTATTAGCTAGTTGGTGAGGTAAC<br>GGCTCACCAAGGCAACGATGTATAGGGGCGACTGAGAGGTTAACCCCCACATTGGTACTGAGACACGGACCAAACTCC<br>TACGGGAGGCAGCAGTGAGGAATATTGGTCAATGGGCGCGAGCCTGAACCAGCCATGCCGCGTGCAGGATGACGGCC<br>TATGGGTTGTAAACTGCTTTTGTACAGGAACGAAACGGCTCTTACGTGTAAGTATCGACCTGAGAGTATCTGCAAAGGATCG<br>GCTAACTCCGTGCCAGCAGCCGCGGTAATACGGGGATCCAAGCGTTATCCGGATTTATTGGGTTTAAAGGGTGCGTAG<br>GCGGTTAGATGCCGAATGAGTAGTAGGGCGTGAAATCCCGGCGATTCGTGATAACCGGATTATTCGTACTGTTCGAAGGATCC<br>GCGTAGGCGCAAGGATTACCTTCAGTTCGGCAATGATACAGGATTCGCCCACTGATAACGAATACGGAGAGCAGTAAACGATG<br>ATAATCGTTGTGCGCTGAAACATGGCACATCCCGGTAAGCGAAAGGCATTAAGCGAAACCAATAATCAGCAGCCATCTTCGCAAGA<br>ATGAAACTCAAAGGAATTGACGGGGGCCCGCACAAGCGGAGGAGCATGTGGTTTAATTCGAATGATACGCGAGGAACCTT<br>ACCTGGGCTTGACATCCCTTGGGCACGCAAACTGGACGAAACCGTTCTTAGTGCCGCAGTAACACCTTCAAGCT<br>GGCACTCGTGCTGCATGGCTGTCGTCAGCTCGTGCCGTGAGGTGTTGGGTTAAGTCCCGCAACGAGCGCAACCCCTATCT<br>TTAGTTGCCAGCATTCGGCGACTCTGAGGAAACTGCCGGTGCAAGCCGGAGGAAGGTGGGGATGACGTCAAATCATC<br>ACGGCCCTTACGGCCAGGGCTACACACGTAAGTTACAATGGGCATCCAACAGAGAGCCGATACCGCGAGGTGGAGCAA<br>ATCTTGAAACATGTTCTCAGTTCGGATTGGAGTCTGCAACCCGACTCCATGAAGTTGGATTCGCTAGTAATCGCGCATCAGC<br>CATGGCGCGGTGAATACGTTCCCGGGCCTTGTACACACCGCCCGTCAAGCCATGGAAGTTGGGGGTGTCCTGAAGTCCGTTAT<br>CAGCCTCGGAGCGTGAAACCTTCTCTACTCGAAGTTGGATTAATCGCGCATCAGCCATGGCGCGGTGAATACGTTCCCGGGCCTTGTACACACCGCCCGTCAAGCCATGGAAGTTGCCTGAAGTTCGTGCCTGAAGTTCGTGCCTAGTAATCGCGCATCAGC<br>ATACGTTCCCGGGCCTTGTACACACCGCCCGTCAAGCCATGGAAGCTGGGGGTGCCTGAAGTCCGTGACTGGGCT<br>CGACCTAGGGACCGGTGACTGGGCT |

FIG. 16D

| | | | |
|---|---|---|---|
| Bacteroides_acidifaciens_A40_NR_028860_7 | Bacteroides_acidifaciens | NR_028607 | SEQ ID NO: 8 | TATCATGGCTCAAGATGAACGCTAGCTACAGGCTTAACACATGCAAGTCGAGGGGCAGCATGGAAGTTTGCTTGCAAAC TTTTGATGCGACCGGCGCACGGGTGAGTAACACGTATCCAACCTGCCTCATACTCGGGATAACCTTCGGAAATGAAGAAAG ATTAATACCCGATGTGCATAGTCCTACCGCACCCAAGACAAACGATGGAATATTAAGAATTTCGGTATGGAGATGGGGATG CGTTCCATTA GTTAGTTGGCGGGGTAACGGCCCACCAAGCCGACGATAGGTAGGGGTTCTGAGAGGAAGGTCCCCCACATTGGAACTG AGACACGGTCCAAACTCCTACGGGAGGCAGCAGTGAGGAATATTGGTCAATGGACGAGAGTCTGAACCAGCAGTTGTATGCC GTGAAGGATGAACGGCCTATGGGTTGTAAACTTCTTCCACGTGTGGGAATAAGAATGTTCCACGTGTGGATCCGAGATTA TTGGG ATATGAATAAGAAGCACCACCGGCTAAATTCGTGCCAGCAGCCGCGGTAATACGGAGGATCCGAGCGTTATCCGGATT TATTGGG TTTAAAGGGAGCGTAGATAGATGTGGATTGTTAAGTCAGTTGTGAAAGTGGATGCGCAAGCGCACGGAAACATGTTAGC ACAGTCACTGACTGAATAACGCTGCTGTTTGCGATACAGTGCTTGCACCGCTGAATAATGCTGAGAAATGTGGGTATCAA GCGAGAACGATATACGCTGGTAGTCC AAGGCAGCTAACTTGACTGCCAGTGTAACGGCCAAGCAAGCCGGGCGATGACGTCAAGTCATCATGCCCCTTATGTCCG GGGAATACGCCAAACGCAGAAAGCATTAAGCATTAAGTATTCCACCTGGGG ACACAGTGAAACTTAAAACGATGAATAAGCAAAGGAATTCACTCCACGTGTAACATGGGAAGCATGGAATTGGGCGAGG TCAAGCGAAGGT TACGGAGGAACCTTACCCGGTCAGTCTCGGGCTTACTAGCGCAAGGGGATATCAACGCAAACCATATAAGTAAACGGAAG GT GCTGCATGGTTGTCGCGTCCTGAGAGGTCAAGCTGCTGAAGGTGTCCGTGAATCCCCCTGGGTAATCGGACATCGCAGGT TCGTCAAGG ATGACGGCATGGAGTCCCCGCATTTAACCCTGTCCACTCCAGAAGGGCCATGAAAGGCAAGGCTAACATCCCAAAGGATA ACCCGGAAGTCCAGCTCAGCCCTTGGGGGAATTAAACCCTATCGGGGATCGGGATAAGGGAAGCAAAGTAGCTGTACCGTCTC ACCGCGCGGTAATGGACGTTCCCGGGCCTTGTACACACCGCCCGTCAAGGCATGGAAGCATGGGGGGTGTCCAGTGGTTCACGAGT AGCTGCAAGAATGCGCGCGGGTCAAGGAATCACTAGTAAAGCA ATGGCGCGGTGAATACGTTCCCGGGCCTTGTACACCCCACGCGTCAAAGCCATGAAAGGTGGGCATGAATCGAAGTACGT AACCGCAAGATGTCCTAGGCTAACTTGCGACTGGAGCCGAAGGGCG | 
| Bacteroides_caccae_ATCC_43185_DSM_19024_NCBI_X839_51 | Bacteroides_caccae | X83951 | SEQ ID NO: 9 | ATGAACGCTAGCTACAGGCTTAACACATGCAAGTCGAGGGGCATCCAGTTTGCTTGCAAACAAACGCTGGCGACCGG CGCACGGGTGAGTAACACGTATCCAACCTACCTCATACTCGGGGATAACCCGGGGAAATCCGGGCTAATACCGGATAG CATATATTTCCCGCATGGGNNNATATTAAGAAATTCCGGTATGAGATGGGGATGCGTTCCATTAGTTGTTGGGGGGGT AACGGCCCACCAAGACGATACGATAGGGATACTGAGAGGAATATCCCGGCTCACAATGAGAGAGACGCCAAAG TCCTACGGGAGGCAGCAGTGAGGAATATTGGTCAATGGACGCGAGTCTGAACCAGCCAAGTCGCGTGAAGGATGACTG CCTATGGGTTGTAAACTTCTTTTATATGGGAGGATAACGCGGAATACGCGAGATGGTTTCCACGTGTACCATATGAATAAGGAT CGGCTAACTCGTCGTGCAGCAGCCGCGGTAAGTTTGCACCTGTGAAATCCGTGAATATCGCGGCTTAACCGCGAAGCTGCATCGA TAGGGTGGGGGAATTCGTGGTGTACGGTGAATATGCGCGGAAGCGGTGAAATCCATGAAATAGCTGGAGAACGATCGATCTGGGAGCG TAGAGGTGAAATTCTCTAGAGTGGTAGGAAAAGTTCAAGTCATGAAGGCAATCCCGATGTAGTAGCGCTGGAGCGAACTCGAAGGACATCAAGCATGGAGGAGTACGACTGTAACGATATGAAGGCGTTATGAAGCCTACT GGAGTGTAACTCGGCTGTTTGCGATATACGATAGAGCGCAAGCAAAGCGGAGAACATCGCCGGGAGCTACGCACCAGTAACGA TGAATACTCGCTGTTTCCCGGATCTGGCCAAGTAGGCAATCCGAAACGATTAGCTGCGGCGGACTCACAGTGGGT TCTACCCGGGCTGTGCCGCAGCTAACGCATTAAGTATTCCACCTGGGGAGTACTGCGACCAGCAACCGGAGGTG AAGGGCCAAACGCAGGAAGGGAAGCCATATTAGGCCACCATTAAGGCCGAAGGAGCGATCCAAGTCCACAGGTG GAGACACCGGGCTCAAAACTCCTGAGAGCCAGCAGTGATAACTTCGGTAAAATGCCCTTGACACGTGACGAAG CTGAGGACTCTACACCGGCTGTTACAACCATGTGGCAAGGGACGGAAACCGCATCCCAAAACCTC CGGGGCTACACACCGCCCCGTCAAGCCATGGAAGCCGGGGGTGCCCGAGCGATGCCGCGGTAACCGGGCAAGGAG ATACGTCGAATCCGCCGCGCGCCGACTCACGAAAGCTCTAGAGGTAAACCAGGTGGAATGCCTTAATCACGGACCAAGAG NGT | 
| Bacteroides_caccae_JCM9498_NCBI_E_U136686 | Bacteroides_caccae | EU136686 | SEQ ID NO: 10 | GTTTGATCCTGGCTCAGGATGAACGCTAGCTACACGCTTAACACATGCAAGTCGAGGGGCATCAGTTTGCTTGC AAACCAAAGGTTGGCGACCGGCGACGGGTGAGTAACACGTATCCAACCTACCTCATACTCGGGGATAACCCGGGG AAATGCCGGCTAATATCCGATGGCATATATTTCCCGCATGGGGAAAATGGAAGATATAGGTAGGGGATGCGTTCCAA TAGTTTGTTGGGGGCGTAACGGCCACCAAGGCGACGATAGGTAGCCGATCCTGAGAGGAAGGATCCCCACATTGGAA CTGAGACACGGTCCAAACTCCTACGGGAGGCAGCAGTGAGGAATATTGGACAATGGGCGAGAGCCTGATCCAGCAAG CTGAAGACACAACTTCTAACGGAGGAGCTGAAGCAGGCCCCCGAGATAACAGAGGATCCGCCAACGCGCAAAATTCGTGCCTATGGGCATGAAG TAGCCGATATACCCGACGTGTCAAGTTTCTGCGGTCGTTTTAAGCCAGGCATGAAAAATTCCGTGTCTGAACCGGCAT GTACCATATATGGAATAAAGGGTTCACGATACAAAACGATGGCGACGTGACGAATGTTGGCAAGATTATGGGCTATGAG TGGCAGTTCGACCGCGCACGCTAAGGACGGCTACACTGGGAATTCAGAATCGGGGAGCCAAACGCGATGACGACGCGATA CAAGGAAACTTTGGGGGTAAGCGTAAGAAGACGGAGAATGGTGGTGAACTGTGTGAAGTGCCCACATTTAAGCACGATAAAT TGCCGAAGGCGCATCACTGACAGACAGCTCACTGGTGAGTGTAACATGACGGTGAATGAGCTTAAGCTTCTTAAAGAGATAGAGATACCGG |

FIG. 16E

| | | | |
|---|---|---|---|
| Bacteroides_eggerth ii_1_2_48FAA_NCBI_ACWG01000065 | Bacteroides_egger thii | ACWG01000006 5 | SEQ ID NO: 11 | AGTCCACACAGTAAACGATGAATACTCGCTGTTTGGCATAGAGTAAGGCGGCCAAGCGAAAGCATTAAGTATTCCACCT<br>GGGAGTACGCCCGGCAAGCGTAAACTGAAACTCAAAGGAATTGACGGGGGCCCGCACAAGCGGAGGAACATGTGGTTTAATTC<br>GATGATACGCGAGGAACCCTTACCCGGGCTTGAAATGAATTGCAAATGAATATCCGGAAACCATAACGGAAGGCATTTGTG<br>AAGGTGCTGCATGGTTGTCGTCAGCTCGTGCCGTGAGGTGTCGGCTTAAGTGCCATAACGAGCGCAACCCTATCTTCA<br>GTTACTAACAGGTCATGCTGAGGACTCTAGCAGGACTGCCGTGTGAGGAAGTGGGGATGACGTCAAATCA<br>GCACGGCCCTTACGTCCGGGCTACACACGTGTTACAATGGCCGGTACAGAGGGTACCGAAGGTGCGACTAATCGGCGATCA<br>ATCCCAAAAACCTCTCTCAGTTCGGATTGAAGTCTGCAACCCGACTTCATCAGTAATCGGCATCA<br>GCCATGGCGGTGAATACGTTCCCGGGCCTTGTACACACCGCCCGTCAAGCCATGAAAGCCGGGGTACCTGAAGTA<br>CGTAACCGCAAGGAGCGTCCTAGGGTAAAACTGGTAATTGGGGCTAAGTCGTAACAAGGTAGCCGTACCGGAAGGTGC<br>GGCTGGAACACCTGTTCT |
| Bacteroides_eggerth ii_DSM_20697_NCB I_ABVO01000045 | Bacteroides_egger thii | ABVO01000004 5 | SEQ ID NO: 12 | TTACAATGAAGAGTTTGATCCTGGCTCAGGATGAACGCTAGCTACAGGCTTAACACATGCAAGTCGAGGGGCAGCATGA<br>TTGAAGCTTGCTTCAATCGATGGCGACCGGCGCACGGGTGAGTAACACGTATCCAACCTGCCGATAACTCGGGGATAG<br>CCTTTCGAAAGAAAAGATTAATACCCGATAGTATATTTCGCACATGGTTTCACTATTAAAGAATTTCGGTTATCGATGGG<br>GATGCGTTCCATTAGATAGTTGGCGGGTCCAAACTGGATCAACGATGAGGAGAATATTGGTCAATGACGAGAGTCTG<br>CCACATTGGAACTGAGAACAGTAGCGTAGAAAGATGCTCCCTATGGTGTTAAACTCTTTATACGGTGAATATACGGCAT<br>AACCAAGTAGCGTGAAGGATGACTGCCTATGGTGGTGTAAACTCTTTATACGGGAATAAAGTCGAGATCCGAGCGTT<br>CTCCTTTGTATGTACCGTATGAATAAGGAACCGCAGCGTAGGCGGGTAACTTGATGAGTTTGCGCCGTGTCAACGCTTA<br>ATCCGGATTTATTGGGTTTAAAGGAGCGTAGGCGGACATAGGAGACTTTCGTGAAAGTTTGCGCGCTGTCAAAAATT<br>GCAGTTGATACTGGGTACTTGAGTGTGCAGCAGGATAAATCGTGGTGATGTGAACCAGCATCAGTAATCGGCATCAACG<br>AAGAACTCCGATTGGCGAAGGCAGTCTACTGGACTTCACAGGGCGTGAAAGTGCTGAAAGGCGGAAGCATTAA<br>GATATTCCACCTGGGGAGTGCAACACGGAATTGCAAATCCGAGGAACCTTACCGATATTCGCGCTGTTGTTATGGCGGAATCCCCAAAGCGGAATCCCCGAAGTACCCTTA<br>GTTGGCATGGCAATGAATATCCGGAGGAACCTTACCCGGGCTTGAAATTGGCAGCCGCCAAGTACCCTTA<br>GGCCCGTATCTATAGTTACTTACCTCAGCTGTCTGAGACTGTTACAAATGGGGGGTTACAACCGCAAAATTG<br>CCCTATCTATAGTTACTTACCTCAGCTGTCTGAGACTGCTACAAATGGGGGTACAAGGCCAATGGGATCACG<br>TAATCGCGACTAATCAGCACGGCCGGTGAATACGTTCCCGGGCCTTGTACACACCGCCCGTCAAGCCATGGGAGCCGGG |

FIG. 16F

| | | SEQ ID NO: | |
|---|---|---|---|
| Bacteroides_faecis_DSM_24798_NCBI_GQ496624 | Bacteroides_faecis | SEQ ID NO: 13 | GGTACCTGAAGTACGTAACGCAAGGAGCGTCCTAGGGTAAGTGATTGGGGCTAAGTCGTAACAAGGTAGCCG TACCGGAAGGTGCGGCTGGAACACCTCCTT GATGAACGCTAGCTACAGGCTTAACACATGCAAGTCGAGGGGCAGCATTTGCTTGCAAACTGGTGAGAGTGGCGAAC CGGCGCACGGGTGAGTAACGCATGGTTAATACCTGCCAAGTACAGAATCGGGATAACCTGAGGGTAGACGGCT ATAGCGGCCCACCAAACCTTCGATGATAGAAGGTCCCCACATTGGAACTGAGACACGGTCCAA ACTCCTACGGGAGGCAGCAGTGAGGAATATTGGACAAGGGAATATTGCCGCAATGGGCAAGAAGTGGCGAAGGATGAC TGCCCTATGGGTGTAAACTTCTTTTATATGGGAATAAAGTGAGCCACGTGTGGCTGATTTGTATGTACCATATAAGAAGC ATCGGCTAACTACCGTGCCAGCAGCCGCGGTAATACGGAGGATCCAAGCGTTATCCGGATTATTGGGTTTAAAGGGAGC GTAGGTGGACAGTTAAGTCAGTTGTGAAAGTTTGCGGCTCAACCGTAAAATTGCAGTTGATACTGGCTGTCTTGAGTACA GTAGAGGTGGGCGGAATTCGTGGTGTAGCGGTGAAATGCTTAGATATCACGAAGAACTCCGATTGCGAAGGCAGCTCA CTGGACTACAACTGACACTGAGGCTCGAAAGCGTGGGGAGCAAACAGGATTAGATACCCTGGTAGTCCACACGGTAAAC GATGAATACTCGCTGTTTGCGATATACAAGTCAAGCAGCCAAGCGAAAGCATTAAGTATTCCACCTGGGGAGTACGCCGG CAACGGTGAAACTCAAAGGAATTGACGGGGGCCCGCACAAGCGGAGGAACATGTGGTTTAATTCGATGATACGCGAGGA ACCTTACCCGGGCTTAAATGCCATTGAATGTGAAGGTGTAACTTACGTGATCAATGCGCAAACACGGAAGAACCTCAAAAGCCTCT CGGAGACTACACAGTCTTTACAATGGAAGGATGCTACAAGACTGAGGCTCGAAAGCCTCT AATACGTTCCCGGGCCTTGTACACACCGCCCGTCAAGCCATGGGAGTCGTAATACCCGTGAGCGCGGGTGA GGGTCCTCTAGGGTAAACTGGTAATTGGGGCTAAGTCGT |
| Bacteroides_finegold ii_B16_NCBI_EU722 740 | Bacteroides_finegoldii | SEQ ID NO: 14 | GAGTTTGATCCTGGCTCAGGATGAACGCTAGCTACAGGCTTAACACATGCAAGTCGAGGGGCAGCACGGGTGAGT AACACGTATCCAACCTACGGGATAGCCTTTCGAAAGAAAGATTAATACCTGATGGCTAAAACTGGTTATCCGGTATTC GATGGGAATGCGTTCCATTAGTTTGTTGGCGGGGTAACTGGCCTACCAAGGCTTTGATGGTCTGAGAGGAA GGTCCCCCACATTGGAACTGAGACACGGTCCAAACTCCTACGGGAGGCAGCAGTGAGGAATATTGGTCAATGGACGGG AGTCTGAACCAGCCAAGTCGCGTGAAGGATGACGGCCCTATGGGTTGTAAACTTCTTTTATACGGGAATAAAGTTGGGT TATGAATAAGGATCCGATGACTTGTACCGTATAAGCAGCGGCTAACTACGTGCCAGCAGCCGCGGTAATACGGAGGA TCAAGCGTTATCCGGATTTATTGGGTTTAAAGGGTGCGCAGGTGGGAAGCTAAGTCAGCGGTGAAATCTTAGAGCTTAGAGCTTGCAG GCAGTAAACGATGAATACTCGCTGTTTGCGATATACAGTAAGCGGCCAAGCGAAAGCATTAAGTATTCCACCTGGGGAGT ACGCCGGCAACGGTGAAACTCAAAGGAATTGACGGGGGCCCGCACAAGCGGAGGAACATGTGGTTTAATTCGATGATAC GCGAGGAACCTTACCCGGGCTTAAATTGCAATGCGATAGGATAGACATAGAGCATGCGCAAACACGGAAGAACCTCAAAAG CCTAGCCGGGACAAGCGTTCAGTTCGCGAATACGTTCCGGAATACGTCCCGTGAAACACGGAAGAACCTCAAAAG GGACAAGCGTTGAAGGATAAGCTGTAATACGCGTGAGGATGCCGCCGTCAAGTCATGGTGCCCCGCCAGCGATCCGAAGGGT CGGACAAGGATAAGCGTCAGTTCGGAATCGCTAGCCAACCGCGGTGAGATCACCGGTGTGAATACGGTCGTACACAGG CCCTGAAGTACGTTAGCGTAATTGGTAATTGGGGTCAAGTCGTAACAAGGTAACC |
| Bacteroides_finegold ii_DSM_17565_JCM _13345_NCBI_AB22 2699 | Bacteroides_finegoldii | SEQ ID NO: 15 | AGAGATTAGATCCTGGCTCAGGATGAACGCTAGCTACACAGCTTAACACATGCAAGTCGAGGGGCAGCATTTAGTTTGCTT GCAAACTGAAAGATGGCGACCGGCGCACGGGTGAGTAACACGTATCCAACCTGCCGATTCGCGATAACTCAAGGATAGCCTTTCGAA AGAAAGATTAATAACCGCCTATGAGCTGATCTATTAAAGAAATTCGGTTTATCGATGGGGATGCGTT CATTAGCTAGTTGGTGTAGGTAACGGCTCACCAAGGCTATGATAGGGTAGGAGGCCCCATTG GAACTGAGACACGGTCCAAACTCCTACGGGAGGCAGCAGTGAGGAATATTGGTCAATGGACGCAAGTCTGA ACCAGCCAAGTGGCGTGAAGGATGAAGGGCCTAAGGGTTGTAAACTCTTTTGTAAACGGTAATGACCAGCC AAGTAGCGTTTAGCGTATGAAAGAGTAAAAAGGGATCAACATGGATAATGAAGTGATCACACGTGATTTTGGATTT TATTACCGTATGAATAAGGATCAACCGTAATACGCCGGAATAACGTTGTGCCCCGATGCGGCTCAACCGTGAAATTGCAGTTGA TACTGGCAGTCTTGAGTACACGTAGAGGTAGACGTTAGCGGTGAAATGCTTAGCGTAAAGCCGAGAAATCACGATGGA CGATTGCGAAGGCAGCTCACTGGACGATGATCCGACTGAGGCTCGAAAGCGTGGGGAGCAAACAGGATTAGATACCCT |

FIG. 16G

| | | | |
|---|---|---|---|
| Bacteroides_finegold ii_JCM_13346_NCBI_AB222700 | Bacteroides_fineg oldii | AB222700 | SEQ ID NO: 16 | GGTAGTCCACACAGTAAACGATGAATACTCGCTGTTTGCGATATACGGTAAGGCGAAAGCGTTAAGTATTCC ACCTGGGGAGTACGCCGGCAACGTGAAACTCAAAGGAATTGACGGGGCCCACACAAGCGGTGGAACATGTGGTTTA ATTCGATACGGAGGAACCTTACCCGGGCTTGAAACTTAAATTACATTTGAATATCTGAAAGACGTAAGGCAAAT GTGAAGGTGCTGCATCAGTTGTGTCTGAGAGACTGTGCCGTCAGCTCGTGCCGTGAGATGTTGGGTTAAGTCCCGCAACGAGCGCAACCCTTATCT CAGTTACTAACAGGTCATGCTGAGGGACTGCTAAGATGTGAGGAAGGTGGGGATGACGTCAAA TCAGCACGGCCCTTACGTCCGGGGCTACACACGTGTTACAATGGCCGGTACAGAGGGCAGCTACCTGGTGACAAGGATG CTAATCCCAAAACCTCTCTCAGTTCGGATCGGAAGCTGCAACCGACTTCGTGAAGCTGGAATCGCTAGTAATCGCGA TCAGCCATGCTGCGGTGAATACGTTCCCGGGCCTTGTACACACCGCCCGTCAAGCCATGGAAGTCTGGAGTACCC GTACGTTACCCAGAGCGTTCTAAGGTAAAATGGGGTATTGGGGGTAAGTCGTAACAAGGTAACC |
| | | | SEQ ID NO: 17 | GAGTTTGATCCTGGCTCAGGATGAACGCTAGCTACAGGCTTAACACATGCAAGTCGAGGGACCACGGCACGGGTGAGT AACACGTATCCAACCTCGGATAAAGTGAAACTCAAGGATAGCCTTTCGAAAGAAGATTAATAATACCGGATAGGTGTATC GATGGCGGATGCCTTCCATTAGGGATTGCCGCATTGTGAATGAATTAGCTAGTAGATGGGGATGGCATGCGTTCCATTAGGTTAGT TGGTCCCCCACATTGGAACTGAGACACGGCCCAACTCCTACGGGAGGCAGCAGTGAGGGAATATTGGTCAATGGACGGG AGTCTGAACCAGCCAAGTACGCGTGAAGGATGACTGCCCTATGGGTTGTAAACTCTTTTATACGGGAATAATGTGTATGGG TATGAATAAGGATCGGCTAACTCCGTGCCAGCAGCCGCGGTAATACGGAGGATCCAAGCGTTATCCGGATTTATTGGGT TCTTAGGTACGAGAGGTGGGCGAATTGCGTTAAGTCAGTTGTGAAAGTGCATCGCTCAAGCGTGAAATTGCGGCGA AGGCAGCTCACTGAACACTCGGTGCTGTTGCGGGGAGAAATGCTTGTGGGCAAAGTGAAGTGGAAGCGGTGTGTAGCGGTGAAATGCATAGATACCCTGAGTAGTCCACA CAGTAAACGATGAATACTCGGTGCGTGGGGAAAGCGAAAGCAAAGCGGCCCAGAAGCAAAGGTGGAAAGATACGCGAGGAA CGGTGCAACCCTTATCTCAGTTCGGATCGGAAGACTGGAATCTGGGCAGAACTCGGAACACTCTGG GATGACGTCAAATCAGCACGGCCCTTATGTCCGGGCAGACACACGGTTGCACACCCGCCCGTCAAGCCATGGAAGTACC TGAAGATGCTAATTAGCCAACCCCGGCCCATTCCCTGGTGAATACGTTCCCGGGCCTTGTACACACCGCCCGTCAAGCCATGG AAGCTGGGGATGCCTGAAGTAAACCTGGCTAATGATCAGGATGGTTCACTAATACCGCTCAAGCCATCCAGGGTACCC CTGAAGTCAAGAGAGTTTGATCCTGGCTCAGGATGAACGCTAGCTACAGGCTTAACACATGCAAGTCGAGGGGCAGCATTT TATAGCAATATAAAAGATGGCCTAATACCCGATGGGAACACAGGTGAGTAACACGTATCCAACCTCGCGATAACCGCGATAACCCT TCGAAAGAAGGGCCTAATACCGATGGGAACACAGGTGAGTAACACGTATCCAACCTGCCGCTGTGGATATTAAAGAACTTCGGTTATCGATGGGGAT GCGTTCCATTAGCTTGTTGGCGGGGTAACGGCCCACCAAGGCTTCGATGATAGGTACGAGCGGCAGAGTGTAAC CATTGAAACTGGAGACACGGTCCAAACTCCTACGGGAGGCAGCAGTGGGGAATATTGGTCAATGGACGAAGTCTGAAC CAGCCAAGTACGCGTGAAGGATGAAGGCCTTGCGGTTGTAAACTTCTTTTATAAAGTGAAGATCAGTATGCATACTG TTTGTATGTACCCATGAATAAGGACCGGCTAATCTCGTGCCAGCAGCCGCGGTAAGTTGCCGGTCAACCCGTAAAATTGCAG CGGATTATGGGGTTTAAAGGGCGCTCTTGAGCTACAGGCTAGCTGTGAAATGCTTAGGGTTAAATTGGGGGTGAAATGCTTAGATATCACGAAG AACTGCGATTGCGAAGGCAGCGTCACTGACGATACTGCTCCGTGGCGATAAGGTAACCACACAAAGCGATTGAT ACCCTGGTAGTCCACACAGTAAACGATGAATACTCCGTGTTGGGGGACTATACGGCCCTCGGAATTCCTCCAGTAACGAACAGCAGCC CATTTCCAAAACCTCGATAACCACCCCTGGTAATCACCCGCCCGTCAAGACACCGCCCGCTCAAGCCATCTAAGCCATCCAATGATGTGCTCCCGGCCTTGTATACACCGCCCGTCGACACCCGCTAAGCTCATGAAGCTGGGCATTACCGAAAAGTCAAGCTAACAACCGAAGAAGAAGCTCCGAAGTAGAAGGATAAGCGCTGCAA CCTTATCGTATGGTCTGCATTGGTTGTCCTGGGCACCTGGGCCATCCCAAAGCTGTTACAATGAGCAGGGTACCCTCTCATTACCGAAAGCGAAAGCCGGAAAGAATAGGCCAATAACAGGATTGATCAAACAGGAT GACGCAAATCAGCACGGCGCGTCTTACGTCCGGGGATACGTTATAACCTCCGGAATCCGAAGCTGTACAGACAGC GATGTGATGCCAATCAGGGCGCCATAAACCCCTCAGTTCGGGATCTGCGAACTACGGTGAAGCTGGAATTCGCTAG TAATCGCGATCAGCCATGCCGCGGTGAATACGCTCCCGGGCCTTGTATACACCGGCCCGTCAAGCCATGGGGAGTTGGGGATATACGCGAGGCTGAAGTCGTAACAAGGTAGCCG TACCGGAAGGTGCGGCTGGAACACCTCTTCT |

FIG. 16H

| | | | |
|---|---|---|---|
| Bacteroides_helcoge nes_NCBI_AB51070 2 | Bacteroides_helco genes | SEQ ID NO: 18 | AGAGTTTGATCCTGGCTCAGGATGAACGCTAGCTACAGGCTTAACACATGCAAGTCGAGGGGCAGCATTGTCATAGCAA TATGACAGATGGCGACCGGCGCACGGGTGAGTAACACGTATCCAACCTGCCTTCAACTCGGGAATAGCCTTCGAAAGA AAGATTAATGCCGGATGGCACTGAAAGAGTCATCCTTTCAGTTGAAGAATTCGGTGGAAGATGGGGATGCGTTCCA TTAGCTTGTTGGCGGGGTAACGGCCCACCAAGGCATCGATGATAGGGGCATCGAGACCAGACCAGCGGGGATGCCGGCAGCAGTGGGGAATATTGGACAAGCCTGGTCCTGAGACACGGTCCAAACTCCTACGGGAGGCAGCAGTGAGGAATATTGGTCAATGGGCGCGAGCCTGAACCAGCCAAGCATTGGAACCTGAGACACGGTCCAAACTCCTACGGGAGGCAGCAGTGAGGAATATTGGTCAATGGGCGCGAGCCTGAACCAGCCAAGTCGCGTGAAGGAAGACTGCCCTATGGGTTGTAAACTTCTTTTATAAGGGAATAAAGTGCAGTACGTGTACTGTTTGTACGGTATTCTATGAATAAGCACCGGCTAACTACGTGCCAGCAGCCGCGGTAATACGTAGGGGGCAAGCGTTATCCGGATTTACTGGGTGTAAAGGGTGCGTAGGCGGGATATGCAAGTCAGAAGTGAAAGCCCGGGGCTCAACCCTGGGACTGCATTCTGAAACTGTATATCTTGAGTGTCGGAGAGGTAAGCGGAATTCCTAGTGTAGCGGTGAAATGCGTAGATATTAGGAGGAACACCAGTGGCGAAGGCGGCTTACTGGACGATAACTGACGCTGAGGCACGAAAGCGTGGGGAGCAAACAGGATTAGATACCCTGGTAGTCCACGCAGTAAACGATGAATGCTAGCTGTTTGGGGGCTTGACCCTTCAGTGCCGCAGCTAACGCAGTAAGCATTCCACCTGGGGAGTACGTTCGCAAGAATGAAACTCAAAGGAATTGACGGGGGCCCGCACAAGCGGAGGAACATGTGGTTTAATTCGATGATACGCGAGGAACCTTACCTGGGCTTGACATGTTGCGGAATCCTGTAGAGATACAGGAGTGCCTTCGGGAACCGCAACACAGGTGGTGCATGGCTGTCGTCAGCTCGTGTCGTGAGATGTTGGGTTAAGTCCCGCAACGAGCGCAACCCTTATCCTATGTTGCCAGCATGTAATGGCATGGAACATATAGGGACACTGCCGCGCGCCAAGCGGAAAGGGTGTACGTCTAAGCATCATGCCCTTAACGTCTGGGCTACACACGTGCTACAATGGCCGGTACAGAGGGCAGCTACACAGCGATGTGATGCAAATCCCAAAAAGCCGGTCTCAGTTCGGATTGGAGTCTGCAACCCGACTCCATGAAGCTGGAATCGCTAGTAATCGCGCATCAGCCATGGCGCGGTGAATACGTTCCCGGGCCTTGTACACACCGCCCGTCAAGCCATGGAAGCCGGGGGTACCTGAAGTCGGTGACCGCAACCGCAAGGAGCGAGCCTAGTAAGCGCAAGGTCAGCTTAACCGCAAGGAGCGAGCCGCCTAAGGTGGGACAGATGATTGGGGTGAAGTCGTAACAAGGTAACC |
| Bacteroides_helcoge nes_P_36_108_NCB I_CP002352 | Bacteroides_helco genes | SEQ ID NO: 19 | AGAGTTTGATCCTGGCTCAGGATGAACGCTAGCTACAGGCTTAACACATGCAAGTCGAGGGGCAGCATTGTCATAGCAA TATGACAGATGGCGACCGGCGCACGGGTGAGTAACACGTATCCAACCTGCCTTCAACTCGGGAATAGCCTTCGAAAGA AAGATTAATGCCGGATAGCACTGAAAGAGTCATCCTTCAGTTAAAGAATTTCGTTGGAAGATGCGTTCCA TTAGCTTGTTGGCGGGGTAACGGCCCACCAAGGCATCGATGATAGGGGCATCGAGACCAGACCAGCGGGGATGCCGGCAGCAGTGGGGAATATTGGACAAGCCTGGTCCTGAGACACGGTCCAAACTCCTACGGGAGGCAGCAGTGAGGAATATTGGTCAATGGGCGCGAGCCTGAACCAGCCAAGTCGCGTGAAGGAAGACTGCCCTATGGGTTGTAAACTTCTTTTATAAGGGAATAAAGTGCAGTACGTGTACTGTTTGTACGGTATTCTATGAATAAGCACCGGCTAACTACGTGCCAGCAGCCGCGGTAATACGTAGGGGGCAAGCGTTATCCGGATTTACTGGGTGTAAAGGGTGCGTAGGCGGGATATGCAAGTCAGAAGTGAAAGCCCGGGGCTCAACCCTGGGACTGCATTCTGAAACTGTATATCTTGAGTGTCGGAGAGGTAAGCGGAATTCCTAGTGTAGCGGTGAAATGCGTAGATATTAGGAGGAACACCAGTGGCGAAGGCGGCTTACTGGACGATAACTGACGCTGAGGCACGAAAGCGTGGGGAGCAAACAGGATTAGATACCCTGGTAGTCCACGCAGTAAACGATGAATGCTAAGTGATACTCGCTGTTTGGCGATACAGTCAAGCGGCCAAGCGAAACGTGAGGTTTAAGTGTGAAGGTGCTGCATGGTTGTCGTCAGCTCGTGCCGTGAGGTGTTGGGTTAAGTCCCGCAACGAGCGCAACCCTTATCCTTAGTTACCAGCGGTTCGGCCGGGAACTCTAGGGAGACTGCCGCCGTAAGGCGGAGGAAGGCGGGGATGACGTCAAGTCATCATGCCCCTTACGTCACGGGCTACACACGTGTTACAATGGGGGGTACAGAGGGCAGCTACATGGCAATAGGATGCAATCCCCAAAAACCCCATCTCAGTTCGGATCGGAGTCTGCAACCCGACTCCGTGAAGCTGGAATCGCTAGTAATCGCGAAATCAGCCATGTTGCGGTGAATACGTTCCCGGGCCTTGTACACACCGCCCGTCAAGCCATGGAAGCTGGGGGTACCTGAAGTCGGTGACCGCGAACCGCAAGGAGCGCACCGCCTAAGGTAACAAGGTAACAAGGTAACC TGCGGCTGGAACACCT |
| Bacteroides_intestin alis_AM_1_NCBI_A B437413 | Bacteroides_intesti nalis | SEQ ID NO: 20 | GAGTTTGATCCTGGCTCAGGATGAACGCTAGCTACAGGCTTAACACATGCAAGTCGAGGGGCACGGCGCACGGGTGAGT AACACGTATCCAACCTGCCCGGATATTCCGGGATAGCCTTCGGGAAAGAATTAATACCGGATATGCTCATTAGTTTGTTGGCGGGATAAGTCGATAATC GGTCCCCCACATTGGAACCAGCCAAGTCCAAACTCTACGGAGGCAGCAGTGAGGAATATTGGTCAATGGTCTGAGAGGAA AGTCTGAACCAGCCAAGTCGCGTGAAGGATGACTGCCCTATGGGTTGTAAACTTCTTTTATATGGGAATATTGTGGT TACGAATGGAGCGTGCCAGCAGCAGCCGCGGTAATACGGAGGATCCGAGCGTTATCCGGATTTATTGGGTTTAAAGGGT TTAAGGGCGGTCAGCAGGGATTCGGGAAATCGGGCGGTGTAAGTCCGTGAAGTTGCGGCGGAATATCACGGAGGAAC TCTTGAGTGCAGCAGAGGAAAGCGGAATTCCATGTGTAGCGGTGAAATGCGTAGATATATGGAAGAACACCGATTGCGA AGGCAGCTTTCTGGACTGATACTGACGCTGAGGCACGAAAGCGTGGGGATCAAACAGGATTAGATACCCTGGTAGTCCACA |

FIG. 16I

| | | | |
|---|---|---|---|
| Bacteroides_intestinalis_DSM_17393_JCM_13265_NCBI_ABJL02000006 | Bacteroides_intestinalis | ABJL02000006 | SEQ ID NO: 21 | CAGTAAACGATGAATACTCGCTGTTTGCGAGCAAGCGCAAGCGGCCAAGCGAAAGCATTAAGTATTCCACCTGGGGAGTACGCCG GAACCGGTGAAACTCAAAGGAATTGACGGGGGCCCGCACAAGCGGTGGAGCATGTGGTTTAATTCGATGATACGCGAG GAACCTTACCCGGCAACCTTATCTTAAGTTACTAACAGCTGCATGGTTGTGTCAGCTCGTGCCGTGAGGTGTCGGGCTTAAGTGCC ATAACGAGCGACGTCAAATGCTAATCAGCACGCGCCCCTCTCTCCAGTTGCCAGCATCAGTTGGGAAGGCAGAAGCAGTACA GGGGATGACGTCAAGTCATCATGGCCCTTATGACCAGGGCTTCACAGTCCGCAACCGGCTACACACGTGTTACAACCCTGGGGGATAGAATGGCAGAAGCAGCAACCGGCTGGGATCTCGAAACCGACTCGCAACCCGTGTACACCGTCGTGAAGCTGGAATCGCTAGTA ATCGCGATGTCAGCATGCATCAGCATGCCGCGCGTGAATACGTTCCCGGGGCCTTGTACACACCGCCCGTCAAGCCATGAAAGCCGGGGG GTACCTGAAGTATGCTAGCGTCCTAGGTAAAACTGGTAATGCGTAAGTCGTAACAAGGTAACC |
| Bacteroides_intestinalis_JCM_13266_NCBI_AB214329 | Bacteroides_intestinalis | AB214329 | SEQ ID NO: 22 | TTACAATGAAGAGTTTGATCCTGGCTCAGGATGAACGCTAGCTACAGGCTTAACACATGCAAGTCGAGGGGCAGCATGA CCTAGCAATAGGTTGATGGCGACCGGCGCACGGGTGAGTAACGCTATCCAACCTGCCGATTATTCGGGATAGCCTTT CGAAAGAAAGATTAATAATACTCCGGGATAGCCCTTTGTTGGGCCCCCGATAAGAAAGAATTTCGATAATCGATGGGGATGC GTTCCATTAGTTTGTTGGCGGGTAATGCTCTAATCCAAGACATCGATAGATAGTAGGGGTTCTGAGAGGAAGGTCCCCACAT TGGAACTGAGACACGGTCCAAACTCCTACGGGAGGCAGCAGTGAGGAATATTGGTCAATGGACGAG AGTCTGAACCAGCCAAGTAGCGTGAAGGATGAAGGCCCTACGGGTTGTAAACTTCTTTTATATGGGAATATGTTACCA TACGAATAAGGATCGGCTAACTCCGTGCCAGCAGCCGCGGTAATACGGAGGATGCAAGCGTTATCAGCGGTTATTGGGT TAAAGGGAGCGTAGCGCAGAGGTAGGCGGAATCAGTGTGAAAGTTCGTGGTAGCGGAATGCTTAGACGACTGATCGGCGAAACTGATTCTCTACTCCTACGGCTTGGGGTGACGGGTCCCAGAGATGGAAAGTACCCTCTGGGGAGGAACGCCGGTGGCGAAGGCGAGTACTGGATAGTACGCCGTAAGTCGAAGCCTTACGTACCAG GCAAACGATGAATACTCAGGAGACATTGGCCCTCTCAGTGCGCAGCTAACCGCAAGGAATTGACGGGGGCCCGCACAAGCGGTGGA ATATGGACACGGTCCAAGACTATTGACGCGAGGACACCGGAAGACATTCACCTTCCCTGACAAGGTCCCGGTCGGGGAGCCCGTCGGAGTC ATCGGGATGATGTGATCAGCATCAGCCTCGTGCACCGTGCATGATTAAGGGCCTCATACCAGATCGCCGGAATCGCTAGTAAACTGGTAACACACGCCCCGTTCAGCTCGCCTTGTACACACCGCCCGTCAAGCCATGAAAGCCGGGGGTACCTGAAGTCGTAACAAGGTAACC |
| Bacteroides_ovatus_3_8_47FAA_NCBI_ACWH01000036 | Bacteroides_ovatus | ACWH010000036 | SEQ ID NO: 23 | TTACAATGAAGAGTTTGATCCTGGCTCAGGATGAACGCTAGCTACAGGCTTAACACATGCAAGTCGAGGGGCATTT AGTTTGCTTGCAAAGAAATCGAAATGGCAAGCTATCCAACCGATAGGTCAACGACCAGCAACGCTACCGAAATTAATCGTATCAGCAG GCCCTTTTCGAAAGAAAAAGATTAATAATACCGGATGCATACGATATGCATGATATTTTTATTAAAGAATTTCGGTTATCGATGG |

FIG. 16J

| | | |
|---|---|---|
| Bacteroides_ovatus_3941_NCBI_AY895193 | Bacteroides_ovatus | AY895193 | SEQ ID NO: 24 | GGATGCGTTCCATTAGTTTGTTGGCGGGTAACGGCCCACCAAGACTACGATGGATAGGGGTTCTGAGAGGAAGGTCC CCCACATTGGAACTGAGACACGGTCCAAACTCCTACGGGAGGCAGCAGTGAGGAATATTGGTCAATGGGCGAGAGCCT GAACCAGCCAAGTAGCGTGAAGGATGAAGGCTCTATGGGTCGTAAACTTCTTTTATAGGGGAATAAAGTTTTCCACGTGT GGAATTTGTATGTACCATATGAATAAGGAGGCCGTAGGTGGATTGTTAAGTCAGTTGTGAAAGTTTGCGGCTCAACCGTA TATCCGGATTATTGGGTTTAAAGGGAGCCGTAGGCGGGCGAATTAAGTCAGCGGTGAAATGCTTGCGGCTCAACCGTAAAT GCAGTTGAAACTGGTTCGCTTGAGTACAGTAGAGGTGTGCGGAATTCGTGGTGTAGCGGTGAAATGCTTAGATATCAC GAAGAACTCCGATTGCGAAGGCAGCTCACTGGACTGTAACTGACGCTGAGGCTCGAAAGTGTGGGTATCAAACAGGATT AGATACCCTGGTAGTCCACACAGTAAACGATGAATACTCGCTGTTTGCGATATACAGTAATAAGCGAAAAGCATTA AGTATTCCACCTGGGGAGTACGCCGGCAACGGTGAAACTCAAAGGAATTGACGGGGGCCCGCACAAGCGGAGGAACAT GTGGTTTAATTCGATGATACGCGAGGAACCTTACCCGGGCTTAAATTGCAACAGAATATTGAAACAGTATAGCCGTA AGGCTGTTGTGAAGGTGCTGTTCACAAGGCTGTCCCTCAGTTGCCATCCAGTTGGGGCTGGGCACTCTGAGGCTCACTGCT GACGCAAATCAGCACGGCTAACTCCGGGCGTCCGGATCGGAAGCTAACCGCCCACAGCCGAAAGGCGCTACCTCTGAGATGGCCATTATTGGCGGCGGCCGAACCCCGGGATCCGAAGCCATGGAAGCCGTAAGCCGTAAGATGGTAAGTGCCTTCGGGATCCCGGGCCGAAGTCTGCAACCGACTTCGTGAGGCTGATGCGGGGCCCGCAAGCCGTCAAGCCATGAAAGCGCCGAAGAGCACATTGGGCCACTAAGCCGTGAGCCATTGAACAAGGCTAAGGCTTGAAGACTTCGTGAAGCCGTGGATCAAGGCCTTAACCACAGTAAGTGCTGCCGAAGCTGAAAGCGCCACCCGGTTGGATCGCACACATCCGGGCGAAGTCAACTCCAAGCCTTGCCGCCGGAAGTGAATCATTTGATAATTCAAGGAAGGTTAATGCCAAGAATAGTATCCAGGCAACCTTCAGCACCGCGAAGAAAAAAAAGCGAAGAAAAAGAAAAAAAAGAAAAAAAAGAGGGCTACCGTAAGGCGTAGCGCGTAACCGGACCCTGGGGTAACGGAAGCCCTTATATACCCCAAGCTAACCGCGCCGCCCGCACAAGCCGGAGGAACAGGGGGGGCCGAAGAAAGCGCGCCCGGCAGGAACAGGGGCCAAGGGAGCCCGAAAAGCCTAAGGAGCCATCGAGGCGTAAGCCCGGTAATGCCCCCCCGGATCGGGCCCTCCTAAAGCCCTCCTAAAACCCCTTAGGGTAAAAC |
| Bacteroides_ovatus_ATCC_8483_JCM_5824_NCBI_AB050108 | Bacteroides_ovatus | AB050108 | SEQ ID NO: 25 | [sequence continues] |

FIG. 16K

| | | | |
|---|---|---|---|
| Bacteroides_ovatus_B3_NCBI_EU72273 4 | Bacteroides_ovatus | EU722734 | SEQ ID NO: 26 | TGCATGGTTGTCGTGCAGCTCGTGCCGTGAGGTGTCGGCTTAAGTGCCATAACGAGCGCAACCCTTATCTTAGTTACTAA CAGGTTATGCTGAGGACTCTAGAAGACTGCCGTGACAAGTCGGAAGTGCCCAAATGACCACGGC CCTTACGTTCCGGGCTACACACGTGCTACAATGGGGGGTACAGAAGGCAGCTACCTGGTGACATGATGCTAATCCAAA AACCTCTCCAGTTCGGATCGAAGTCTGCAACTTCGTGAAGCTGGAATTCGCTAGTAATCGCGCATCAGCATCA CGGGGTGAATACGTTCCCGGCCCTTGTACACACCGCCCGTCAAGCCATGAAAGCCGGGAGTACCTGAAGTACGGTAACC CGGAAGGAGCGTCCTAGGGTAAACTGGTAA | 
| | | | SEQ ID NO: 26 | GATGAACGCTAGCTACAGGCTTGACACATGCAAGTCGAGGACGGCGACGGCGCACGGTGAGTAACACGTATCCAACCTGCC GATAACTCCGGGAATAGCCTTCGAAAGAAAGATTAATACCGGATAGTCGGTTGGTTATGGGGATGCGTTCCATT AGTTTGTTGGCGGGGTAACGGCCCACCAAGGCGACGATACGTAGCCGGGGTACAGAAGGCAGCTACCTGAAACT GAGACACGGTCCAAACTCCTACGGGAGGCAGCAGTGAGGAATATTGGTCAATGGACGCAAGTCTGAACCAGCCAAGTA GCGTGAAGGATGAAGGCTCTATGGGTTGTAAACTTCTTTTATAGGGAATAAAGTGCCGATACGTGCCGGATCTGACTGTA ACCCGATAGAATAAGCACCGGCTAACTCCGTGCCAGCAGCCGCGGTAATACGGAGGATGCGAGCGTTATCCGGATTTATTGGGTGTAAAGGGTGCGTAGGCGGACTAGAGTG ATTGTTAAGTCAGTGGTGAAATGCCAGAGCTCAACTCTTGAAACTGCCATTGATACTGGCCAGTCACTAGAGG ACTACGGTCAGTGCCAAGGTCACGAAGCGGAAATATCACAGATATGTCTCACCGTAGACTAGAACGAGGCAGCAACCTCGGA GCTGTTTGCGAGTAACGGCCCACGAAGCGCCAAGGAATCCGATACTAAACGTGCGAAGCCTGAGGGTATTAGCTTATAGAT AATTGAAGGGTCGTGTCGCTACAGAACTTGGTGAGGCTGAAGAGGCAATCGGTGCCCATAACGAGGTGTACAAGCTTT CAAATACATAAGCCTGCTCTCAGGTCGGGACGAAGACTCGCATAATCTGCCGATCAGGGAGCGGGGGAAAAGGAGGGAACGC CCGCTAGGTCCCGAACAAGCGGATTGCGAGAAATGAAACCGAAGAGGTAGACCGTTCCCGGGTAGGACGTCCCTACGGGG AACTACATCTAGGCAACACCTTTCCCACCCCCGGGACCCCGGGCCAAAACACCCGGTCGAATACCCACCAAGAAGTCAAAGCAAGGAGCT | 
| Bacteroides_ovatus_SD_CC_2a_NCBI_A DMP01000058 | Bacteroides_ovatus | ADMP010000 58 | SEQ ID NO: 27 | AGAGTTTGATCCTGGCTCAGGATGAACGCTAGCTACAGGCTTAACACATGCAAGTCGAGGGGCAGCATTTAGTTTGCTT GCAAACTAAAGATGGCGACCGGCGCACGGGTGAGTAACGCGATCCAACCTGCCGATAACTCGGGGATAGCCTTTCGA AAGAAAGATTAATACCCCATTAGTTGTTGGCGGCGGTAACTCCGATAGTATATTAAAGCGCATTAAAGAGCCTTCGGTT CCATTAGTTGTTGGCGGGGTAACGGCCCACCAAGGCGACGATACGTAGCCGGGGTACAGAAGGCAGCTACCTGGGATGCGTT GAACTGAGACACGGTCCAAACTCCTACGGGAGGCAGCAGTGAGGAATATTGGTCAATGGACGAGAGTCTGAACCAGCC AAGTACCGTGAAGGATGACTGCCCTATGGGTTGTAAACTTCTTTTATACAGGGGATAAAGTATTCCACGTGTGGAATTCTGT ATGTACCGCATATGAACGATGAATAAGGATCCGGCTAACTCGGTGCCAGCAGCCCGCGGTAATACGGAGGATCCAAGCGTTTATCCGGATT TATTGGGGTTTAAAGGGAGCGTAGGCGGATAGTAAGTGTCGGCTTAAAATTCACGATTCGCTCTGAAACTGCCTTATCTTGATGCGTT CATTAGAGGAGAACAGGAATTCGTGCCGTGAAATGCTCGGTAAGGGGTTATCAACAGGATTAGATTAACCCTG GATTGCGAAGGCAGTCATCGGTAGATACATGCCTCCAAGCTAAAGGAAGCGGCCAAGCGGAAACAGGATTAGATACCCTG GTAGTCCACAGAGTAAACGATGAATACTCGCTGTTTGCGATATACAGCAATGTCAGAGCCAAGCGAAAGCATTAGAGTATTCCAC CTGGGAGTACGCCGGCAACCGTGAAACCCAAAATTGACGGGGGGCCCGCACAAGCGGAGGAACATGTGGTTTAAT TCGATGATACGCGAGGAACCTTACCCCGGGCTTGAACTGCACAGTGATCAAGCGGGAAGTCAGCAAGCCAAGCGAACCCTTATCTTT AGTTACTAACAGGTCATGCATGCTGAAGGACTCTAGAGAACGATGAAGGTCCGTCAAGTCAGCTCGTGCCGGAGTAAGTGCAAGTCA AGCAGGCCCTTATGTCCAGGGCTACACGCTGCAAACTCCGGGGGAAAGACATCGGGTACCTGGGAACACGCTGAAGT ACGAACCGGCCAAGGAAGCCCGTCGTAAGAACTCGTAACAAGGTAAAAAACGGTAACGCGAAGCGTACCGGAAGGTG CGGCTG | 
| Bacteroides_ovatus_SDG_M85_3Cy_NC BI_DQ100446 | Bacteroides_ovatus | DQ100446 | SEQ ID NO: 28 | GATCCTGGCTCAGGATGAACGCTAGCTACAGGCTTAACACATGCAAGTCGAGGGACACCGGCGCACGGTGAGTAACACG TATCCAACCTGCCGATAATCTCGGGAATAGCCTTCGAAAGAAGATTAATACCGGATAGTTAAGCTCGGTTATGCATGGGG DATGCGTTCCATTAGGAAACTCCTGAAGTGCCTCAGCGGGTAACGCCCTGAGGCCAATGATACGATAGGGGCCCCAAGGCTCCCT CCACATTGGAACTCCTGAAACGCTCCAAATCCCTACGGGAGGCAGCAGCAGCCAAAATTCTTGGGAATATGGCATGTCAAAAGCAGAGTGGAAATATTGGTCAATGGGCGAGCAGCCCTG CCACCAGCCAAGGAATGCCCCGTCGTAAGAACTCGTAACAAGGTAAAAACGGTAACGTGAAGCGTACCGGAAGGTG |

FIG. 16L

| | | | |
|---|---|---|---|
| Bacteroides_sp_1_1_30_NCBI_ADCL01000128 | Bacteroides_sp_1_1_30 | ADCL01000128 | SEQ ID NO: 29 | [sequence] |
| Bacteroides_sp_20_3_NCBI_ACRQ01000064 | Bacteroides_sp_20_3 | ACRQ01000006 4 | SEQ ID NO: 30 | [sequence] |

FIG. 16M

| | | | | |
|---|---|---|---|---|
| | | | | CTGGCGACAGGGAGCGAATCCCCAAACCACGTCTCAGTTCGGATCGGAGTCTGCAACCCGACTCCGTGAAGCTGGATTCGCTAGTAATCGCGCATCAGCCATGGCGCGGTGAATACGTTCCCGGGCCTTGTACACACCGCCCGTCAAGCCATGGGAGCCGGGGGTACCTGAAGTCCGTAACCGCGAGGATCGGCCTAGGGTAAAACTGGTGACTGGGGCTAAGTCGTAACAAGGTAGCCGTACCGGAAGGTGCGGCTGGAACACCTCCTTTCT |
| Bacteroides_sp_2_1_22_NCBI_ACPQ01000117 | Bacteroides_sp_2_1_22 | ACPQ01000117 | SEQ ID NO: 31 | TTACAATGAAGAGTTTGATCCTGGCTCAGGATGAACGCTAGCTACAGGCTTAACACATGCAAGTCGAGGGGCAGCATTTTAGTTTGCTTGCAAACTAAAGATGGCGACCGGCGCACGGGTGAGTAACACGTATCCAACCTGCCGATAACTCGGGGATAGCCTTTCGAAAGAAAGATTAATATCCGATGGTATATTAAAACCGCATGGTTTTACTATTAAAGAATTTCGGTTATCGATGGGGATGCGTTCCATTAGTTTGTTGGCGGGGTAACGGCCCACCAAGACTACGATGGATAGGGGTTCTGAGAGGAAGGTCCCCCACATTGGAACTGAGACACGGTCCAAACTCCTACGGGAGGCAGCAGTGAGGAATATTGGTCAATGGACGAGAGTCTGAACCAGCCAAGTAGCGTGAAGGATGACTGCCCTATGGGTTGTAAACTTCTTTTATATGGGAATAAAGTATTCCACGTGTGGAATTTTGTATGTACCATATGAATAAGGATCGGCTAACTCCGTGCCAGCAGCCGCGGTAATACGGAGGATCCGAGCGTTATCCGGATTTATTGGGTTTAAAGGGAGCGTAGGTGGATTGTTAAGTCAGTTGTGAAAGTTTGCGGCTCAACCGTAAAATTGCAGTTGAAACTGGCAGTCTTGAGTACAGTAGAGGTGGGCGGAATTCGTGGTGTAGCGGTGAAATGCTTAGATATCACGAAGAACTCCGATTGCGAAGGCAGCTCACTAGACTGCAACTGACACTGATGCTCGAAAGTGTGGGTATCAAACAGGATTAGATACCCTGGTAGTCCACACAGTAAACGATGAATACTCGCTGTTTGCGATATACAGTAAGCGGCCAAGCGAAAGCATTAAGTATTCCACCTGGGGAGTACGCCGGCAACGGTGAAACTCAAAGGAATTGACGGGGGCCCGCACAAGCGGAGGAACATGTGGTTTAATTCGATGATACGCGAGGAACCTTACCCGGGCTTAAATTGCATTTGAATAATCTGGAAACAGGTTAGCCGCAAGGCAAATGTGAAGGTGCTGCATGGTTGTCGTCAGCTCGTGCCGTGAGGTGTCGGCTTAAGTGCCATAACGAGCGCAACCCTTATCTTTAGTTACTAACAGGTCATGCTGAGGACTCTAGAGAGACTGCCGTCGTAAGATGTGAGGAAGGTGGGGATGACGTCAAATCAGCACGGCCCTTACGTCCGGGGCTACACACGTGTTACAATGGGGGGTACAGAAGGCAGCTACCTGGCGACAGGATGCTAATCCCAAAAACCTCTCTCAGTTCGGATCGAAGTCTGCAACCCGACTTCGTGAAGCTGGATTCGCTAGTAATCGCGCATCAGCCATGGCGCGGTGAATACGTTCCCGGGCCTTGTACACACCGCCCGTCAAGCCATGAAAGCCGGGGGTACCTGAAGTACGTAACCGCAAGGAGCGTCCTAGGGTAAAACTGGTAATTGGGGCTAAGTCGTAACAAGGTAGCCGTACCGGAAGGTGCGGCTGGAACACCTCCTTTCT |
| Bacteroides_sp_2_2_4_NCBI_ABZZ01000168 | Bacteroides_sp_2_2_4 | ABZZ01000168 | SEQ ID NO: 32 | TACAATGAAGAGTTTGATCCTGGCTCAGGATGAACGCTAGCTACAGGCTTAACACATGCAAGTCGAGGGGCAGCATTTCGCTAGCAATAGTGAAGATGGCGACCGGCGCACGGGTGAGTAACACGTATCCAACCTGCCGATAACTCGGGGATAGCCTTTCGAAAGAAAGATTAATATCCGATAGTATATTAAAACCGCATGGTTTTACTATTAAAGAATTTCGGTTATCGATGGGGATGCGTTCCATTAGTTTGTTGGCGGGGTAACGGCCCACCAAGACTACGATGGATAGGGGTTCTGAGAGGAAGGTCCCCCACATTGGAACTGAGACACGGTCCAAACTCCTACGGGAGGCAGCAGTGAGGAATATTGGTCAATGGACGAGAGTCTGAACCAGCCAAGTAGCGTGAAGGATGACTGCCCTATGGGTTGTAAACTTCTTTTATATGGGAATAAAGTATTCCACGTGTGGATTTTGTATGTACCATATGAATAAGGATCGGCTAACTCCGTGCCAGCAGCCGCGGTAATACGGAGGATCCGAGCGTTATCCGGATTTATTGGGTTTAAAGGGAGCGTAGGTGGATTGTTAAGTCAGTTGTGAAAGTTTGCGGCTCAACCGTAAAATTGCAGTTGAAACTGGGAGTCTTGAGTACAGTAGAGGTGGGCGGAATTCGTGGTGTAGCGGTGAAATGCTTAGATATCACGAAGAACTCCGATTGCGAAGGCAGCTCACTAGACTGTCACTGACACTGATGCTCGAAAGTGTGGGTATCAAACAGGATTAGATACCCTGGTAGTCCACACAGTAAACGATGAATACTCGCTGTTTGCGATATACAGTAAGCGGCCAAGCGAAAGCATTAAGTATTCCACCTGGGGAGTACGCCGGCAACGGTGAAACTCAAAGGAATTGACGGGGGCCCGCACAAGCGGAGGAACATGTGGTTTAATTCGATGATACGCGAGGAACCTTACCCGGGCTTAAATTGCAAATGAATAATCTGGAAACAGGTTAGCCGCAAGGCATTTGTGAAGGTGCTGCATGGTTGTCGTCAGCTCGTGCCGTGAGGTGTCGGCTTAAGTGCCATAACGAGCGCAACCCTTATCTTTAGTTACTAACAGGTTATGCTGAGGACTCTAGAGAGACTGCCGTCGTAAGATGTGAGGAAGGTGGGGATGACGTCAAATCAGCACGGCCCTTACGTCCGGGGCTACACACGTGTTACAATGGGGGGTACAGAAGGCAGCTACCTGGTGACAGGATGCTAATCCCAAAAACCTCTCTCAGTTCGGATCGAAGTCTGCAACCCGACTTCGTGAAGCTGGATTCGCTAGTAATCGCGCATCAGCCATGGCGCGGTGAATACGTTCCCGGGCCTTGTACACACCGCCCGTCAAGCCATGAAAGCCGGGGGTACCTGAAGTACGTAACCGCAAGGAGCGTCCTAGGGTAAAACTGGTAATTGGGGCTAAGTCGTAACAAGGTAGCCGTACCGGAAGGTGCGGCTGGAACACCTCCTT |
| Bacteroides_sp_3_1_19_NCBI_ADCJ01000062 | Bacteroides_sp_3_1_19 | ADCJ01000062 | SEQ ID NO: 33 | ACAACGAAGAGTTTGATCCTGGCTCAGGATGAACGCTAGCGACAGGCTTAACACATGCAAGTCGAGGGGCAGCACAGGTAGCAATACCGGGTGGCGACCGGCGCACGGGTGAGTAACGCGTATGCAACTTGCCTATCAGAGGGGGATAACCCGGCGAAAGTCGGACTAATACCGCATGAAGCAGGGATCCCGCATGGGAATATTTGCTAAAGATTCATCGCTGATAGATAGGCATGCGTTCCATTAGGCAGTTGGCGGGGTAACGGCCCACCAAACCGACGATGGATAGGGGTTCTGAGAGGAAGGTCCCCC |

FIG. 16N

| | | | |
|---|---|---|---|
| Bacteroides_sp_3_1_23_NCBI_ACRS01000081 | Bacteroides_sp_3_1_23 | ACRS01000008 1 | SEQ ID NO: 34 | ACATTGGTACTGAGACACGGACCAAACTCCTACGGGAGGCAGCAGTGAGGAATATTGGTCAATGGGCGAGAGCCTGAA<br>CCAGCCAAGTCGCGTGAGGGATGAAGGTTCTATGGATCGTAAACCTCTTTATAAGGGAATAAAGTGCAGGACGTGTCC<br>CGTTTGTATGTACCTTATGAATAAGGATCCGGCTAACTCCGTGCCAGCAGCCGCGGTAATACGGAGGATCCGAGCGTTA<br>TCCGGATTTATTGGGTTTAAAGGGTGCGTAGGCGGCCTTTAAGTCAGCGGTGAAATGCTGTGGCTCAACCATAGAATT<br>GCCGTTGAAACTGGGGGCTTGAGTGCGCAAGGGCAGCGGAATTCTGCAAGCGTAGCGGTGAAATGCATAGATATGCAG<br>GAGAACACCGGTGGCGAAGGCAGCTGACTGGACGTGTTGACGGTGTAAGCGCACAGGCTAACCGGGCCAACCTTCAC<br>TAGTATACCCGGTAGTCCACGGTGTAAACGATGATTACTAGCTGTTTGCGATACACAGTTAAGCGGCCAAGCGAAAGCGT<br>TAAGTAATCCACCTGGGGAGTACGCCGGCAACGGTGAAACTCAAAGGAATTGACGGGGGCCCGCACAAGCGGAGGAA<br>CATGTGGTTTAATTCGATGATACGCGAGGAACCTTACCCGGGCTTGAAACGCATTGAGTGTCGGCATTACCGAAACGGT<br>AGCAATAGCCGTTTGCGGACTAGTTACTAACAGGTTAAGCTGAGGACTGTACCAGGTGCTGCAAGCGTAAAGGAGGCCA<br>CGCAAGGGTTGCCACTAGTTAATCAAGCACACGGTGAGGACTTACATGGCCTTACAAATGCCTTACAATGGCTGCGACA<br>CCTGGCGACAGGAGCGAATCGCCAAACACGTTCGTCAGTTCGGATCGGAGTCTGCAACTCGGACTCCGTGAAGCTGGAAT<br>CGCTAGTAATCGCGCATCAGCCATGGCGCGGTGAATACGTTCCCGGGCCTTGTACACACCGCCCGTCAAGCCATGGG<br>AGCCGGGGGTACCGGAAGGTGCGGCTGGAACACCTGAAACGTGGACGGTAAGCTAACGGGCAGGCTGCAAGCCATGGG<br>GTAGCCGTACCGGAAGGTGCGGCTGGAACACCTCCTTCT |
| Bacteroides_sp_3_2_5_NCBI_ACIB0100 0079 | Bacteroides_sp_3_2_5 | ACIB01000079 | SEQ ID NO: 35 | ACAAGAAGAGTGGTCCTGGCTCAGGATGAACGCTAGCGACGACTTAACATGCAAGTCGAGGGGCAGCACAGG<br>TAGCAATACCGGGTGCGGGGGTGAGTAACGCGTATCGAGAGGGGATAACCCGGC GAAAGTCGGACTAATACCCATGGGCACCCGCCGCCAAACCGACAGTGAGGGTTCATCGCTAAAGATTCATCGCTGAATAGGCA<br>TGCGTTCCATTAGCTAGTTGGTGAGGTAAGGCTCACCAAGGCAACGATGGGTAGCCGGCCTGAGAGGGTGATCGGCCA<br>ACATTGGTACTGAGACACGGACCAAACTCCTACGGGAGGCAGCAGTGAGGAATATTGGTCAATGGACGAGAGTCTGAA<br>CCAGCCAAGTACGCGTGAAGGATGAAGGCTCTATGGGTCGTAAACTTCTTTTATATAGGGAATAAAGTGAGGTACGTGTACC<br>CGTTTGTATGTACCTTATGAATAAGGATCGGCTAACTCGTGCCAGCAGCCGCGGTAATACGAGGATCCGAGCGTTA<br>TCCGGATTTATTGGGTTTAAAGGGAGCGTAGGCGGTGCGCCTTGGCCAGTGTGAAAGTGGCTTGGCTCAACCATAGAAT<br>GCCGTTGAAACTGGGGGCTTGAGTCGCAAGACTTGCGGACAGCCGAAGTACGAAATGCATAGATATGCAG<br>CGTTTGTATGTACCTTATGAATAAGGGTGCGTAGGCGGTGCGCCGGTAATACGAGGGATCCGAGCGTT<br>TAGATAGCTGAAACTGGGGGCTTGAGTCCAACGGTGAAACTGCGTAGCAACGGATCAAGGATCCGAGCGGA<br>TAAGTAGTTTGATCCACCTGGGAGTACGCCCAACCGTGAAACTCAAAGGAATTGACGGGGGCCCGCACAAGCGGAGGAA |

FIG. 16O

| | | | |
|---|---|---|---|
| Bacteroides_sp_4_1_36_NCBI_ACTC01000133 | Bacteroides_sp_4_1_36 | ACTC01000013 | SEQ ID NO: 36 | CATGTGGTTTAATTCGATGATACGCGAGGAACCTTACCCGGTCTTGAACGCATTCGGAAGACCTTTCT... |
| Bacteroides_sp_AR20_NCBI_AF139524 | Bacteroides_sp_AR20 | AF139524 | SEQ ID NO: 37 | GAGTTTGATCCTGGCTCAGGATGAACGCTAGCTACAGGCTTAACACATGCAAGTCGAGGGGCAGCTTG... |

FIG. 16P

| | | | |
|---|---|---|---|
| Bacteroides_sp_D1_NCBI_ACAB020000 30 | Bacteroides_sp_D1 | ACAB02000000 | SEQ ID NO: 38 | AGAGTTTGATCCTGGCTCAGGATGAACATGCAAGTCGAGGGGCAGCATTTAGTTTGCTT GCAAACTAAAGATGGCGACCGGCGCACGGGTGAGTAACACGTATCCAACCTGCCCTTTCGA AGAAAAGATTAATACCGCATGGTATTATAAACGCATGGTTTACTATTAAAGAATTTCGATGGGCGCGTT CCATTAGTTTGTTGGCGGGGTAAACTCCGGGGTAAGCAGCAGCAGTGGAATATTGCCACAATTG GAACTGAGACACGGTCCAAATCGACTGGGCTGGGGAGGCAGCAGTGAGGAATATTGGTCAATGAAAGAGGCTGCTCGAGCC AGTAGCCGTGAAGGATGAAGGATCGCTAACTGGCTGCCCTATGGTCTTGTAAACTTCTTTTATACGGAAGAAATAACCGGGATATACCGGGGTTATCGGATT ATGTAACCATATGAATAAGCACCGGCTAACTACGTGCCAGCAGCCGCGGTAATACGGAGGATCCAAGCGTTATC CACTGGGCAGGCGTAGGCGGATAAAGGTGGCGCGAAATCGCCGCGAAGCTCATCAAACAGAAGCTTAGTATCGATCCT GATTGCGAAGGCAGCCTGCGATTGCGAAGGATCAAACGGCCAAGGTGTGGGTATCAACAGGATTAGATACCCTG GTAGTCCACACAGTAAACGATGAATACTCGGCGTTAGAGCTGACAATTCCGTAGCGGCCAAGGCCAACCTGTTAAGTATCGAC CGAAGGATTAAAATTCAAAGAATTGAGCGTTGCAAAGCCCACCACCAGCAGCAGCAATTTCGATGGGCGCCTGGTTAAT GAAGGTGCTGCATGGGTGTCGTCAGCTCGTGGCAAGTCTGGAGACCTAAAGCAGCTGCTAAAACATTAATAAGGCGCCTGCTAATGAGAACCGGCAAATGTTT AGTTACTAACAGGTTCATGCTGAAATTTAGGCGCCTGAAGCCAAACAGAGACTGGAATAAAGCGGCCCGAAGGCAAGCCGCAAGGCCTATGCTGAAGT AATCCCAAAAATCCTCTTGACGCCAGCGATTGTTCGCGCATGACCTATGAAAACGCCGGGAGCTCTAGATAATCGCGATC AGCCATGGCCGGCGTGAATACGTTCCCGGGCCTTGTACACACCGGCCGTCCACAAGGTTAGCAAGTGGGGGGATGAGCTGCCTCTTGAAGT ACACCGCAAGCCGAAGGAGCGTCCTAGGGTAATTGGTAAACTGGTAAATGTGTACAAGGTAGCCGTACCGGAAGGTG CGGCTGGAACACCT |
| Bacteroides_sp_D20_NCBI_ACPT01000 052 | Bacteroides_sp_D 20 | ACPT01000052 | SEQ ID NO: 39 | TTACAATGAAGAGTTTGATCCTGGCTCAGGATGAACGCTAGCTACAGGCTTAACACATGCAAGTCAAGTCAAGGCGCATGA ACTTAGCTTGCTAAGTTTGATGGCGACCGCGCAACGGGTGAGTAACAGCGTATCCAACCTGCCAATGACTCGGGGATAG CCTTCGAAAGAAGAACACATAATACCCGATGATAAGATTAATACCCGATGGTAAACGGTTAGAAGAATTTCGGTATCGATGGG GATGCGTTCCATTAGGTTGTTGGCGGGGTAAACAGCCCTCCAAGCCTACGGGAGGCAGCAGTGAAATACCTTGTCAATGGAAGAGGTCC CCACATTGGAACTGAGACACGGTCCAAATGACTCCGCCTATAGGGAGGCAGCAGTAAACTCCCGTGCCAGCAGCCGCGGTAATACG GACGGGTATAGAACGATAAGCCTATGGACATAAGGCTAAATAAGGGTAACAACACTTGCAAGCTGGGGGAATTTCGGCAATAAAGCTTGTGTAAATGGCACTTAGAT AACCAAGAATCTCCTGAATAAATCAGAGCAGGTCATAACGAAGGATCAAACGGGCTAAATTGCGCTCAAGCGGGTTGCTGAGATATCAC GAAGAACCGCCCGATTGCAAAAGGCACCGAAGGCAGCCGGTAAACTGGCGGAGTAAACAGATATGCGCAAAAGTGGTATCTAACAGGATT AGATACCCTGGTAGTCCAACTCCGAGGATACGGGTTACCCGCTGCGGAGAAACAGAAATGCAGGACATTCGTGCTTAAGGGAAACCGCG TGTGGTTTAATTGACATAGCTGAAAGGGCATGTGACCACCAGGGCTAAGTGGCGTGTCAGCCCCCGGCCAGTCTAGTCTGAAGTGCATCAGCCG CAAGGCAGTTGTGAAATGTTCACGCGCTGTCGCCATCAGGTTACGGTGTCTCAACGTTAGCGAGACAAGCCATATAACGAGCGC ACCCTTATCCGATAGTTACCATCAGTTATGCTGGGGACTCTATCGAGACTGCTATTGACCACAGGGATAAAAGCGTGAAGCAGCAAGG ATGACGTCAAATCATCATGGCCCTTACGTCCAGGCAAGTCATGAAAGCAACGCCATGGCTACAACGTGAGTAGAAAGGGCAGCTGATGCT GCGAATCCGCGATCAGTCCGATCACACACCGCCGTCAAGTCATGAAAGGGAGCCGCGTCCAAGCCATGAAAGCCGG AGTAATCGCGTACCATGTATGAATAAAGAAGCCGTAAGGTGATAGGTAGGCTGAATTGGGGGATAAGTCGTAACAAGGTAGCC CGTACCGGAAGGTGCGGCTGGAACACCTCTTTCT |
| Bacteroides_sp_D22_NCBI_ADCK0100 0151 | Bacteroides_sp_D 22 | ADCK01000015 1 | SEQ ID NO: 40 | TTACAATGGAAGAGTTTGATCCTGGCTCAGGATGAACGCTAGCTACAGGCTTAACACATGCAAGTCGAGGGGCAGCATTT GCTTTGCTTGCAAACTGAAGTTAAACATGCGCAACGGGTGAGTAACGCTGCCAACCTGCCGATAACTGCGGGATAG GCCTTCGAAAGAAGAATTAATCGCCATAGTTTACTATTAAAGAATTCGGTTATCGATGGG GGATGCGTTCCATTAGTTTGTTGGCGGGGTAAACGCAGCCCCCAAGAGACTACGGATATGGCCAAAAAGCAGGAAGGTCC CCACATTGGAACTGAGACACGGTCCAAATGGACTCCGGAGGCAGCAGTGAGGATATTCCGTCAATGAAAGAGAGGGTCTGATGG GGGATTTTGTATGTATGCCATATGCAAGGATGAACGTAAGTCTGGTGCCAGCAGCCGCGGTAATACGGAGGATCCAAGCGT TGGGATTTTTATGTGCGTTAATATCGGTGGGGGATAAGGATACGGATCAGGGTAGCGGTGAAATGCGTAGATATAAGCAGGACAACACCGG TATCCGGATTTATTGGGTTAAGGGTATAAAGGAGCGTAGGCGGATCAATAAGCTCAAGTGTGAAAGTTTGCGGCTCAACCGTAAAACGG CGTACCCGAAGGTGCGGCTGGAACACCTCTTGAATTGTCAGTTGTGAATTGTCAGTTGTGAGTGGATTTGCCGAGCGTAACAAGGTAGCC CGTACCGGAAGGTGCGGCTGGAACACCTCTTTCT |

FIG. 16Q

| | | | |
|---|---|---|---|
| Bacteroides_sp_D2_NCBI_ACGA010000077 | Bacteroides_sp_D2 | ACGA01000007 | SEQ ID NO: 41 | TGCAGTTGAAACTGGCAGTCTTGAGTGTCGCTAGAGGTAGAGGTGGGCGGAATTCGTGGTGTAGCGGTGAAATGCTTAGATATCAC GAAGAACTCGATTGCGAAGGCAGCTCACTAGACTGACTACTGCTGACACGTGAAGCTGTATACAAGGATT AGATACCCTGGTAGTCCACACAGTAAACGATGAATACTGCTGTTGCGATATACAGTAAGCGGCCAAGCGAAAGCATTA AGTATTCCACCTGGGGAGTACGATATACGGCCGAAGGAGAACCTCAAAGGAATTGACGGGGAACCCGCACACAAGCGGAACAT GTGGTTTAATTCGATGATAGCTGCAGATACACCTTAATGGACCGGTAGAGCGAAACTGGGAAGGTAGCGGAAGCCGCTGCAA AGGCATTTGAAGACTGGTTGACCAGGTGCCCATGGTGTGGTTGGGTCGTAAGAGACTGTGCCGTAAGATGAGCGAA CCCTTATCTTAGTTACTAACAGGATGATGACGGTACCTGAGAAGAAGCCCCGGCTAACTTCGTGCCAGCAGCCGCCGCGGTAA GACGTCAAATCAGCACGCACGCCCTTACGTCCGGGGCTACAGTGTTACAAGGCAGCTACCTGGC GACAGGATGCTAATCAGCATGGGCTAACGCAAGGAGCGCTGAATACGTCGCGGTGAATACGTTCGGATTCGTGAAGCTGAAGCGTAACAAGGTAGCCGGT AATGCGGATCGTAACAGCAGTACGTAACGCAAGGAGCGTCCCGGGCTACCAAGACGTCGAAGCATGAACAAGGTAGCCGGT GGTACGTGAAGTGCGGCTGAACGAAGGCAGAGCCCTTGTACAGCCGTAATTGGGCTAAGTCGTAACAAGGTAGCCGCTG ACCGAAGGTGCGGCTGGAACACCTCCTTCT |
| Bacteroides_sp_F_4_NCBI_AB470322 | Bacteroides_sp_F_4 | AB470322 | SEQ ID NO: 42 | AGAGTTTGATCATGGCTCAGGATGAACGCTAGCTACAGGCTTAACACATGCAAGTCGAGGGGCAGCATGAACTTAGCTT GCTAAGCTTGATGCGACCGGCGCACGGGTCTTCCGCATGGGAATGCATCCAACCTGCCCATGTGAACCATTAAAAGAATTTC GGTCATCGATGGGATGCGTT CCATTAGGTTGTTGGCGGGGTAACGGCCCACCAAGGCGCCGATAGCCGCCTACGGGAAGCAGCAGTGAGGAATATTGGCAATT GGGCGAAAGCCTGACAACCGGCCGGCTTTCCGCGGAAGCCTGGCGTAACTTCGTGCCAGCAGCCGCGGTAATACGGAGGATCT GAATCACGCCGGGTCAAAATAAGGGAGCTTAAGCCGACGTATTCGTGAAATGCGTAGAGATCAGGAGAACATCAGTGGCGAAGGCGGCTCTCTGGACTGTAACCT TATTGGGTTCTTGAGTAGAGATAGAGGCGAGGGACCGTTGCCGGGAATTCGTGGTGTAGCGGTGAAATTGCGTAGATATCAC CGATTGCGAAGGCAGGCCTTGAGCAGAGGTATTGGCGTGGTAGACGATTAAAACCGATTAGATACCC GGTAGTCCACAGGTAAACGATGAATACTGCTTGATATTCAAAGCCTTAATTGACGGGGACTGAAGCGTTAAGTATCA CCCTGGGGAGTATGCCGGGCTAACTGTCGCAGCTGTCCCTAGAGACCGGTTGCGCCTAGACACGTGGCGACTCACGTCTC TTCGAAATGGAGACATCGAGGAACCTACAAGGAACACTCGCGCAAGGAAGGAAGGAGCATGCACGTGACACGATCTGGGAT AAGTGTACCGTATGGACTGGCCGCTGTAAAGTTGACGCACGTGCCGCTGTACGGCGTCCGAGACGTTATCGGAT ACTGGGTGTCTTGAGTAGCTAAGGAACGCTAGCTAGAGAGGGACGGACCAGTGATGCTGAAATGCACGAGAATGCACGAAACTC CGATTGCGAAGGCAGCCTGTCGAGTAGTAAGTGCCTGTATCGACAGGTATTAGATACCC GGTAGTCCACAGCGTAAACGATAGAATTCGCATCGGTGCTTGCGATATCACGTAAGCGGCCAAGGCAATTACCA CTGGGGGAGTAGCCCGCGAGGATGAAACTCAAAGGAATTGACGGGGACCCGCACAAGCGGATGGAAGCATGTGGTTTAA TCGATGATACGCGCCCTTACGCTCAGCTCTGTCAGCTGATCCATCACACGTGCGGACTCTGAAGATGGCGCGCCAGTGT GAAGGTCACCAATCAGGTTATGCGTGATGAAGCGTCCCAAGGAACGTGACACGATCAGCAGGTGCCAAGGCAAGTT GATAGCACGACGCGCCCTTACGTCGGGACTCTACACGTGCTACAATGGCGAAGGCAAGCATTACCAGCTGAGACTCAA ATCAGCAGGTCAAATCCATGGAAGCGTACCAATCACGTGCTCTCGTGGCAAGATGACTCAGTGTACGAAGGTGGAATCGCTAGTAAACGCAAGTCAGGCAGCTACGGGTGGAATACGTCCGAGACTTCAAGGATGACTGCACCAGAAGTGACGGCCACGGTGAT |

FIG. 16R

| | | | |
|---|---|---|---|
| Bacteroides_stercoris_ATCC_43183_NCBI_ABFZ02000022 | Bacteroides_stercoris | ABFZ02000022 | SEQ ID NO: 43 | GCTAATCCTGCTAAAGGCTCTCTCAGTTGCGGATTGGAGTCTGCAACCGGACTGCATGAAGTCGAACGGATAATCGG CATCAGCACGCTAACGGCGGTGAATACGTTCCGGGCCTTGTACACACCGCCCGTCAAGCCATGAAAGCCGGGGTACCTG AAGTGGTTAACCGCAAGGAGGAGCGCCCTAGGTGGGGCTGAAAACTGGTAGTCGTAACAAGGTAGCC (truncated representation) |
| Bacteroides_stercoris_ATCC_43183_NCBI_X83953 | Bacteroides_stercoris | X83953 | SEQ ID NO: 44 | ATGAACGCTAGCTAGACAGGCTTAACACATGCAAGTCGAGGGGCAGCATCATCAAAGCTTGCTTTGATGGATGGCGACCGG CGCACGGGTGAGTAACACGTACCAACCTGCCGATCCTATCGAGAATTCGGTTCGATGGGAGTAGCGTTCGAAAGAATTAATACCGGATGGC (truncated representation) |
| Bacteroides_uniformis_21_42_NCBI_AB247139 | Bacteroides_uniformis | AB247139 | SEQ ID NO: 45 | GAGTTTGATCCTGGCTCAGGATGAACGCTAGCTACAGGCTTAACACATGCAAGTCGAGGGGCAGCACGGGAGCAAGT... A (truncated representation) |

FIG. 16S

| | | | |
|---|---|---|---|
| Bacteroides_uniformis_22_80_NCBI_AB247141 | Bacteroides_uniformis | AB247141 | SEQ ID NO: 46 | GTCTTGAGTACAGTAGAGGCAGGCGGAATTCGTGGTGTAGCGGTGAAATGCTTAGATATCACGAAGAACTCCGATTGCG AAGGCAGCTTGCTGGACTGTAACTGACGCTGAGGCTCGAAAGCGTGGGGAGCAAACAGGATTAGATACCCTGGTAGTCCAC ACAGTAAACGATGAATACTCAAAGGAATTGACGGGGGCCCGCACAAGCGGTGGAGCATGTGGTTTAATTCGATGATACGCGA GGAACCTTACCCGGGCTTAAATTGCAGATGAATTGCCGTGCAAATCAGGAGGGCCCTTCGGGATGTCTGTCACAGCTAATGCATTGCATAAAGACGTGAAATCAGAGGCTTAAGAAATCGGTACCAGCCTCCGCCTAATTCATCCCCTCCCGGCGCGGGGCCTAGGGGTAAAACTGGTGATTGGAAGTCGTAACAAGGTAACC (sequence) |
| Bacteroides_uniformis_ATCC_8492_NCBI_AB050110 | Bacteroides_uniformis | AB050110 | SEQ ID NO: 47 | GTTTGATCATGGCTCAGGATGAACGCTAGTAGAACGCTTGCTAGTTAACACATGCAAGTCGAGGGGCAGCATGAACTTAGCTTGCTA AGTTTGATGGCGACCGGCGCACGGGTGAGTAACACGTATCCAACCTGCCGATGACTCGGGATAGCCTTTCGAAAGAA AGATTAATACCGATGGCATAGTTCCCGCCATAAGAATTGACGGTCATCGATGGGATGCGTTCCAT (sequence) GCGTAA |

FIG. 16T

| | | | |
|---|---|---|---|
| Bacteroides_uniformis_B23_NCBI_EU722741 | Bacteroides_uniformis | EU722741 | SEQ ID NO: 48 | GAGTTTGATCCTGGCTCAGGATGAACGCTAGCTACAGGCTTAACACATGCAAGTCGAGGGGCACCGGGGTGAGT<br>AACACGTATCCAACCTGCCGATGACTCGGGATAACCGATGGAAAGATCGGAAAGATTAATACCCGATGAAGTCGGTCAT<br>CGATCGGGGATGCGTTCCATTAGGTTGTTGGCGGGGTAACGGCCCACCAAGCCTACGATGATAGGGGTTCTGAGAGGA<br>AGGTCCCCACATTGGAACTGAGACACGGTCCAAACTCCTACGGGAGGCAGCAGTGAGGAATATTGGTCAATGGACGA<br>GAGTCTGAACCAGCCAAGTAGCGTGAAGGATGACTGCCCTATGGGTTGTAAACTTCTTTTATACGGGGGAATAAAGTGAGGTACGG<br>TATGTAATACCGCTTGCATTTGACGTTACCCGCAGAATAAGCACCGGCTAACTCCGTGCCAGCAGCCGCGGTAATACGGAG<br>GATCCAAGCGTTATCCGGATTTATTGGGTTTAAAGGGAGCGTAGGCGGACTGGTAAGTCAGTTGTGAAAGTTTGCGGCTCAA<br>CCGTAAAATTGCAGTTGATACTGTCAGTCTTGAGTACAGTAGAGGTGGGCGGAATTCGTGGTGTAGCGGTGAAATGCTTAGATATCACGAAGAACTCCGATTGCG<br>AAGGCAGCTCACTGGACTGTAACTGACGCTGATGCTCGAAAGTGCGGGTATCAAACAGGATTAGATACCCTGGTAGTCCAC<br>GCCGTAAACGATGAATACTCGCTGTTTGCGAGTATGAACGCCAAGCGGCCAAGCGAAAATTGACGGGGACCCGCACAAGCG<br>GTGGGAGCATGTGGTTTAATTCGATGATACGCGAGGAACCTTACCTGGGCTTGAAATGTTGCGGTGTACAGATGGAAAG<br>CCATAACGAGCGCAACCCTTATCGCCATCAGTTGGCCATCAGTCCCTCTCCAGTGGCCACTGAAGTTGCCGTGTGTACAGGAAG<br>CATCAGCGCGACATCCGATCCAATCAGCGCACCGCGTCCCCAGGCCCGTGTCCGGGCCCTTGTGGAAATGGGGGGCAAAGGAAGGGGGGGCAGCTA<br>TAATCGCTGACAGTACGACCTCTAGCGAGTAGAAACCTCTCTGAATTTAACCACGCTCACCACAGGTAACC |
| Bacteroides_uniformis_isolate_mat_276_NCBI_AB215082 | Bacteroides_uniformis | AB215082 | SEQ ID NO: 49 | GAGTTTGATCCTGGCTCAGGATGAACGCTAGCTACAGGCTTAACACATGCAAGTCGAGGGGCACCGGGGTGAGT<br>AACACGTATCCAACCTGCCGATGACTCGGGATAACCGATGGAAAGATGATTAATACCCGATGTGTTAAAGTGCTAAACGATGCGTCAT<br>GATGGGGATGCGTTCCATTAGGTTGTTGGCGGGGTAACGGCCCACCAAGGCTACGATGATAGGGGTTCTGAGAGGA<br>AGTCCCCACATTGGAACTGAGACACGGTCCAAACTCCTACGGGAGGCAGCAGTGAGGAATATTGGTCAATGGACGGGAGTCTGAACCAGCCAAGTACGCGTGAAGGATGACTGCCCTATGGGTTGTAAACTTCTTTTATACGGGGAATAAAGTGAGGTACGG<br>TATGTAATACCTGCTCGGCTACGTAAGTCCGACCGGGTTGACCAAACGTGCGGTCAACTCCGTGCCAGCAGCCGCGGTAATACGGAG<br>GATCCAAGCGTTATCCGGATTTATTGGGTTTAAAGGGAGCGTAGGCGGATTGATAGTCGTGAGACGAAGGGCGAACGGCAATTCGTGGTGTAGCGGTGAAATGCTTAGATATCACGAAGAACTCCGATTGCG<br>AAGGCAGTCAGCCTGGAATTTAACCATGCACGGACTTGTGAACGTCAGCCCTGGATTGCGTGCCACAAGCGGGAATGCCAAGTCAGGTGCGGGACCGGTGTTGAAAGCGCGTGGCCTAAAACGATGCGACAATACCACCGGCTGCGCCGGTGGAGCGCGGGCAGCTA<br>AACGAGCGCAACCCGGCCGGCCGTTCAACTGGATGTCATAGCTGTAGAAACCTCTCTGAAATTGGGGGCAAGGTAACC |
| Bacteroides_uniformis_isolate_mat_344_NCBI_AB215084 | Bacteroides_uniformis | AB215084 | SEQ ID NO: 50 | GAGTTTGATCCTGGCTCAGGATGAACGCTAGCTACAGGCTTAACACATGCAAGTCGAGGGGCACCGGGGTGAGT<br>AACACGTATCCAACCTGCCGATGACTCGGGATAACCGATGGAAAGATCGGAAAGATTAATACCCGATGGCTAAAGTCGGTCAT<br>CGATGGGGATGCGTTCCATTAGGTTGTTGGCGGGGTAACGGCCCACCAAGCCTTCGATGATTGGAGGTTCTGAGAGGA<br>AGTCCCCACATTGGAACTGAGACACGGTCCAAACTCCTACGGGAGGCAGCAGTGAGGAATATTGGTCAATGGACGA<br>GAGTCTGAACCAGCCAAGTACGCGTGAAGGATGACTGCCCTATGGGTTGTAAACTTCTTTTATACGGGGGAATATTGGGGG<br>TGTCTTGAGATACAGTTGAGGCGGGAACTCAGTTGTGAAGCGCTAAGTCCGATGAAGTTCGTCATTCGTGGGTTATAATACCTGCTTATCCGGACCCAACCTGGCTAAATCCGGGAAATTGCGCGGTATCCGGTAATATGTCACGGAAAGGGCCCGGCGTAATACGGGAGG<br>GAAGGCAGCTTGCTGGAACTGCTGATGCTGATGCTCGAAAGCGTGGTATCAAACAGGATTAGATACCTGGTAGTCCA<br>CGGCAACGGTCAAACGATGAATACTCGCTGTTTGCGAAGGTCAGATGATCATCAGCACGCAAGCGAAAATTGGACGGGGACGCGGCAAGTGG<br>CGGAACGATGAACTTTATCGATAGGCGCTCGGGCCGTGTCGCCGGACTCTGCCCAGGCGCAATCGCTGTCACAAGGCGTGACGGGAAGG<br>GTGGGAGGATCACTGGCCTCAAAATCAGCACAGCACACGCGTATCAACTGCGGCCCATGATCACACAGGTGGACAGCTA |

FIG. 16U

| | | | | |
|---|---|---|---|---|
| | | | | CACGGCGACGTGATGCTAATCCCTCCTCTCTCAGTTCGGATGGAGTCTGCAACCCGACTCCAGAAGCTGGATTCGCTAGTAATCGCGCATCAGCCACGGCGCGGTGAATACGTTCCCGGGCCTTGTACACACCGCCCGTCAAGCCATGAAAGCCGGGGGTACCTGAAGTGCGTAGCGCCCTAGGGTAAAACTGGTGATTGGGGCTAAGTCGTAACAAGGTAACC |
| Bacteroides_uniformis_NB_13_NCBI_AB117563 | Bacteroides_uniformis | AB117563 | SEQ ID NO: 51 | CAGGCTTAACACATGCAAGTCGAGGGACCGGCGCACGGGTGAGTAACACGTATCCAACCTGCCGATGACTCGGGGATAGCCTTTCGAAAGAAAGATTAATACCCGATGGCTAAAGTCGGTCATCGATGGGGATGCGTTCCATTAGGTTGTTGGCGGGGTAACGGCCCACCAAGCCTTCGATGGATAGGGGTTCTGAGAGGAAGGTCCCCCACATTGGAACTGAGACACGGTCCAAACTCCTACGGGAGGCAGCAGTGAGGAATATTGGTCAATGGACGAGAGTCTGAACCAGCCAAGTAGCGTGAAGGATGACTGCCTATGGGTTGTAAACTTCTTTTATACGGGAATATGTATGTACCGTATGAATAAGGATCGGCTAACTCCGTGCCAGCAGCCGCGGTAATACGGAGGATCCGAGCGTTATCCGGATTTATTGGGTTTAAAGGGAGCGTAGGCGGACGCTTAAGTCAGTTGTGAAAGTTTGCGGCTCAACCGTAAAATTGCAGTTGATACTGGGTGTCTTGAGTACAGTAGAGGCAGGCGGAATTCGTGGTGTAGCGGTGAAATGCTTAGATATCACGAAGAACTCCGATTGCGAAGGCAGCTTGCTGGACTGACTGACGCTGATGCTCGAAAGTGTGGGTATCAAACAGGATTAGATACCCTGGTAGTCCACACAGTAAACGATGAATACTCGCTGTTTGCGAGTAAGCGGCCAAGCGAAAGCGTTAAGTATTCCACCTGGGGAGTACGCCGGCAACGGTGAAACTCAAAGGAATTGACGGGGGCCCGCACAAGCGGAGGAACATGTGGTTTAATTCGATGATACGCGAGGAACTTACCCGGGCTTGAATTGTGAAGGTGCTGCATGGTTGTCGTCAGCTCGTGCCGTGAGGTGTCGGCTTAAGTGCCATAACGAGCGCAACCCTTATCGATAGTTACCATCAGCTGGGGACTCTGTCGAGACTGCCGTCCGTAAGATGGAGGAAGGTGGGGATGACGTCAAATCAGCACGGCCCTTACGTCCGGGGCTACACACGTGTTACAATGGGGGGCAGAAGGCAGCTACACGGCGACGTGATGCTAATCCCTCCTCTCTCAGTTCGGATGGAGTCTGCAACCCGACTCCAGAAGCTGGATTCGCTAGTAATCGCGCATCAGCCACAGCGCGGTGAATACGTCCCGGGCCTTGTACACACCGCCCGTCAAGCCATGAAACCGGGGGTACCTGAAGTGCGTA |
| Bacteroides_uniformis_NB_14_NCBI_AB117564 | Bacteroides_uniformis | AB117564 | SEQ ID NO: 52 | TTTGATCATGGCTCAGGATGAACGCTAGCTACAGGCTTAACACATGCAAGTCGAGGGACCGGCGCACGGGTGAGTAACACGTATCCAACCTGCCGATGACTCGGGGATAGCCTTTCGAAAGAAAGATTAATACCCGATGGCTAAAGTCGGTCATCGATGGGGATGCGTTCCATTAGGTTGTTGGCGGGGTAACGGCCCACCAAGCCTTCGATGGATAGGGGTTCTGAGAGGAAGGTCCCCCACATTGGAACTGAGACACGGTCCAAACTCCTACGGGAGGCAGCAGTGAGGAATATTGGTCAATGGACGAGAGTCTGAACCAGCCAAGTAGCGTGAAGGATGACTGCCTATGGGTTGTAAACTTCTTTTATACGGGAATATGTATGTACCGTATGAATAAGGATCGGCTAACTCCGTGCCAGCAGCCGCGGTAATACGGAGGATCCGAGCGTTATCCGGATTTATTGGGTTTAAAGGGAGCGTAGGCGGACGCTTAAGTCAGTTGTGAAAGTTTGCGGCTCAACCGTAAAATTGCAGTTGATACTGGGTGTCTTGAGTACAGTAGAGGCAGGCGGAATTCGTGGTGTAGCGGTGAAATGCTTAGATATCACGAAGAACTCCGATTGCGAAGGCAGCTTGCTGGACTGACTGACGCTGATGCTCGAAAGTGTGGGTATCAAACAGGATTAGATACCCTGGTAGTCCACACAGTAAACGATGAATACTCGCTGTTTGCGAGTAAGCGGCCAAGCGAAAGCGTTAAGTATTCCACCTGGGGAGTACGCCGGCAACGGTGAAACTCAAAGGAATTGACGGGGGCCCGCACAAGCGGAGGAACATGTGGTTTAATTCGATGATACGCGAGGAACTTACCCGGGCTTGAATTGTGAAGGTGCTGCATGGTTGTCGTCAGCTCGTGCCGTGAGGTGTCGGCTTAAGTGCCATAACGAGCGCAACCCTTATCGATAGTTACCATCAGCTGGGGACTCTGTCGAGACTGCCGTCGTAAGATGGAGGAAGGTGGGGATGACGTCAAATCAGCACGGCCCTTACGTCCGGGGCTACACACGTGTTACAATGGGGGGCAGAAGGCAGCTACACGGCGACGTGATGCTAATCCCTCCTCTCTCAGTTCGGATGGAGTCTGCAACCCGACTCCAGAAGCTGGATTCGCTAGTAATCGCGCATCAGCCACGGCGCGGTGAATACGTTCCCGGGCCTTGTACACACCGCCCGTCAAGCCATGAAAGCCGGGGGTACCTGAAGTGCGTAGCGCCCTAGGGTAAAACTGGTGATTGGGGCTAA |
| Bacteroides_vulgatus_ATCC_8482_NCBI_CP000139 | Bacteroides_vulgatus | CP000139 | SEQ ID NO: 53 | TATTACAATGAAGAGTTTGATCCTGGCTCAGGATGAACGCTAGCTACAGGCTTAACACATGCAAGTCGAGGGGCAGCATGGTCTTAGCTTGCTAAGACTGATGGCGACCGGCGCACGGGTGAGTAACACGTATCCAACCTGCCGTCTACTCTTGGACAGCCTTCTGAAAGGAAGATTAATACAAGATGGCATCATGAGTCCGCATGTTCACATGATTAAAGGTATTCCGGTAGACGATGGGGATGCGTTCCATTAGATAGTAGGCGGGGTAACGGCCCACCTAGTCTTCGATGGATAGGGGTTCTGAGAGGAAGGTCCCCCACATTGGAACTGAGACACGGTCCAAACTCCTACGGGAGGCAGCAGTGAGGAATATTGGTCAATGGGCGCAGGCCTGAACCAGCCAAGTAGCGTGAAGGATGACTGCCCTATGGGTTGTAAACTTCTTTTATAAAGGAATAAAGTCGGGTATGGATACCCGTTTGCATGTACTTTATGAATAAGGATCGGCTAACTCCGTGCCAGCAGCCGCGGTAATACGGAGGATCCGAGCGTTATCCGGATTTATTGGGTTTAAAGGGAGCGTAGATGGATGTTTAAGTCAGTTGTGAAAGTTTGCGGCTCAACCGTAAAATTGCAGTTGATACTGGATATCTTGAGTGCAGTTGAGGCAGGCGGAATTCGTGGTGTAGCGGTGAAATGCTTAGATATCACGAAGAACTCCGATTGCGAAGGCAGCCTGCTAAGCTGCAACTGACATTGAGGCTCGAAAGTGTGGGTATCAAACAGGATTAGATACCCTGGTAGTCCACACGGTAAACGATGAATACTCGCTGTTTGCGATATACGGCAAGCGGCCAAGCGAAAGCGTTAAGTATTCCACCTGGGGAGTACGCCGGCAACGGTGAAACTCAAAGGAATTGACGGGGGCCCGCACAAGCGGAGGAAC |

FIG. 16V

| | | | | |
|---|---|---|---|---|
| | | | | ATGTGGTTTAATTCGATGATACGCGAGGAACCTTACCCGGGCTTAAATTGCAGATGAATTACGGTGAAAGCCGTAAGCCGCAAGGCATCTGTGAAGGTGCTGCATGGTTGTCGTCAGCTCGTGCCGTGAGGTGTCGGCTTAAGTGCCATAACGAGCGCAACCCTTGTTGTCAGTTACTAACAGGTTTCGCTGAGGACTCTGACAAGACTGCCATCGTAAGATGTGAGGAAGGTGGGGATGACGTCAAATCAGCACGGCCCTTACGTCCGGGGCTACACACGTGTTACAATGGGGGGTACAGAGGGCCGCTACCACGCGAGTGGATGCCAATCCCAAAAACCTCTCTCAGTTCGGACTGGAGTCTGCAACCCGACTCCACGAAGCTGGATTCGCTAGTAATCGCGCATCAGCCACGGCGCGGTGAATACGTTCCCGGGCCTTGTACACACCGCCCGTCAAGCCATGGGAGCCGGGGGTACCTGAAGTGCGTAACCGCGAGGAGCGCCCTAGGGTAAAACTGGTGACTGGGGCTAAGTCGTAACAAGGTAGCCGTACCGGAAG |
| Bacteroides_vulgatus_NMBE_6_NCBI_JN084209 | Bacteroides_vulgatus | JN084209 | SEQ ID NO: 54 | TCTGAAAGGAAGATTAATACAAGATGGCATCATGAGTCCGCATGTTCACATGATTAAAGGTATTCCGGTAGACGATGGGGATGCGTTCCATTAGATAGTAGGCGGGGTAACGGCCCACCTAGTCTTCGATGGATAGGGGTTCTGAGAGGAAGGTCCCCCACATTGGAACTGAGACACGGTCCAAACTCCTACGGGAGGCAGCAGTGAGGAATATTGGTCAATGGGCGAGAGCCTGAACCAGCCAAGTAGCGTGAAGGATGACTGCCCTATGGGTTGTAAACTTCTTTTATAAAGGAATAAAGTCGGGTATGTATACCCGTTTGCATGTACTTTATGAATAAGGATCGGCTAACTCCGTGCCAGCAGCCGCGGTAATACGGAGGATCCGAGCGTTATCCGGATTTATTGGGTTTAAAGGGAGCGTAGATGGATGTTTAAGTCAGTTGTGAAAGTTTGCGGCTCAACCGTAAAATTGCAGTTGATACTGGATATCTTGAGTGCAGTTGAGGCAGGCGGAATTCGTGGTGTAGCGGTGAAATGCTTAGATATCACGAAGAACTCCGATTGCGAAGGCAGCCTGCTAAGCTGCAACTGACATTGAGGCTCGAAAGTGTGGGTATCAAACAGGATTAGATACCCTGGTAGTCCACACGGTAAACGATGAATACTCGCTGTTTGCGATATACTGCAAGCGGCCAAGCGAAAGCGTTAAGTATTCCACCTGGGGAGTACGCCGGCAACGGTGAAACTCAAAGGAATTGACGGGGGCCCGCACAAGCGGAGGAACATGTGGTTTAATTCGATGATACGCGAGGAACCTTACCCGGGCTTAAATTGCAGATGAATTACGGTGAAAGCCGTAAGCCGCAAGGCATCTGTGAAGGTGCTGCATGGTTGTCGTCAGCTCGTGCCGTGAGGTGTCGGCTTAAGTGCCATAACGAGCGCAACCCTTGTTGTCAGTTACTAACAGGTTCCGCTGAGGACTCTGACAAGACTGCCATCGTAAGATGTGAGGAAGGTGGGGATGACGTCAAATCAGCACGGCCCTTACGTCCGGGGCTACACACGTGTTACAATGGGGGGTACAGAGGGCCGCTACCACGCGAGTGGATGCCAATCCCCAAAACCTCTCTCAGTTCGGACTGGAGTCTGCAACCCGACTCCACGAAGCTGGATTCGCTAGTAATCGCGCATCAGCCACGGCGCGGTGAATACGTTCCCGGGCCTTGTACACACCGCCCGTCAAGCCATGGGAGCCGGGGGTACCTGAAGTGCGTAACCGCGAGGAGCGCCCTAGGGTAAAACTGGTGACTGGGGCTAAGTCGTAACAAGGTAGCCGTACCGGAAGGTGCGGCTGGAACACCTCCTTCTGAA |
| Bacteroides_vulgatus_PC510_NCBI_ADKO01000087 | Bacteroides_vulgatus | ADKO01000087 | SEQ ID NO: 55 | AGAGTTTGATCCTGGCTCAGGATGAACGCTAGCTACAGGCTTAACACATGCAAGTCGAGGGGCAGCATGGTCTTAGCTTGCTAAGGCCGATGGCGACCGGCGCACGGGTGAGTAACACGTATCCAACCTGCCGTCTACTCTTGGACAGCCTTCTGAAAGGAAGATTAATACAAGATGGCATCATGAGTCCGCATGTTCACATGATTAAAGGTATTCCGGTAGACGATGGGGATGCGTTCCATTAGATAGTAGGCGGGGTAACGGCCCACCTAGTCTTCGATGGATAGGGGTTCTGAGAGGAAGGTCCCCCACATTGGAACTGAGACACGGTCCAAACTCCTACGGGAGGCAGCAGTGAGGAATATTGGTCAATGGGCGAGAGCCTGAACCAGCCAAGTAGCGTGAAGGATGACTGCCCTATGGGTTGTAAACTTCTTTTATAAAGGAATAAAGTCGGGTATGTATACCCGTTTGCATGTACTTTATGAATAAGGATCGGCTAACTCCGTGCCAGCAGCCGCGGTAATACGGAGGATCCGAGCGTTATCCGGATTTATTGGGTTTAAAGGGAGCGTAGATGGATGTTTAAGTCAGTTGTGAAAGTTTGCGGCTCAACCGTAAAATTGCAGTTGATACTGGATATCTTGAGTGCAGTTGAGGCAGGCGGAATTCGTGGTGTAGCGGTGAAATGCTTAGATATCACGAAGAACTCCGATTGCGAAGGCAGCCTGCTAAGCTGCAACTGACATTGAGGCTCGAAAGTGTGGGTATCAAACAGGATTAGATACCCTGGTAGTCCACACGGTAAACGATGAATACTCGCTGTTTGCGATATACTGCAAGCGGCCAAGCGAAAGCGTTAAGTATTCCACCTGGGGAGTACGCCGGCAACGGTGAAACTCAAAGGAATTGACGGGGGCCCGCACAAGCGGAGGAACATGTGGTTTAATTCGATGATACGCGAGGAACCTTACCCGGGCTTAAATTGCAGATGAATTACGGTGAAAGCCGTAAGCCGCAAGGCATCTGTGAAGGTGCTGCATGGTTGTCGTCAGCTCGTGCCGTGAGGTGTCGGCTTAAGTGCCATAACGAGCGCAACCCTTGTTGTCAGTTACTAACAGGTTCCGCTGAGGACTCTGACAAGACTGCCATCGTAAGATGTGAGGAAGGTGGGGATGACGTCAAATCAGCACGGCCCTTACGTCCGGGGCTACACACGTGTTACAATGGGGGGTACAGAGGGCCGCTACCACGCGAGTGGATGCCAATCCCCAAAACCTCTCTCAGTTCGGACTGGAGTCTGCAACCCGACTCCACGAAGCTGGATTCGCTAGTAATCGCGCATCAGCCACGGCGCGGTGAATACGTTCCCGGGCCTTGTACACACCGCCCGTCAAGCCATGGGAGCCGGGGGTACCTGAAGTGCGTAACCGCGAGGAGCGCCCTAGGGTAAAACTGGTGACTGGGGCTAAGTCGTAACAAGGTAGCCGTACCGGAAGGTGCGGCTG |

FIG. 16W

| | | | |
|---|---|---|---|
| Bacteroides_xylaniso ivens_DSM_18836_ NCBI_AB510713 | Bacteroides_xylani solvens | AB510713 | SEQ ID NO: 56 | GCTCAAGGATGAACGCTAGCTACAGGCTTAACACATGCAAGTCGAGGGGCAGCATTTAGTTTGCTTGCAAACTAAAGAT GGCGACCGGCGCACGGGTGAGTAACGCGTATCGGAATAACCTGCCGATAAGTCGGGGATAGCCTTTCGAAAGAAAGATTAATA TCCGAGTATATTAAAACCGGCATAATAACGGTTTATCGATGGATACGAAATTCGGTTCATCGATGGGAAGGTTCCCATTAGTTGTTG GCGGGGTAACGGCCCACCAAGGCAACGATGCAGTGGGGGATGAGATCAGTAGACCGGCGGCACCCTCCACAGG... |
| Bacteroides_xylaniso ivens_SD_CC_1b_N CBi_ADKP01000087 | Bacteroides_xylani solvens | ADKP010000008 7 | SEQ ID NO: 57 | AGAGTTTGATCCTGGCTCAGGATGAACGCTAGCTACAGGCTTAACACATGCAAGTCGAGGGGCAGCATTTTAGTTTGCTT GCAACTAAAGATGGCGACCGGCGCACGGGTGAGTAACGCGTATCCGGATAACTCGGGGATAGCCTTTCGA AAGAAAGATTAATATCCGAGTATATTACTATTAAAGAATTTCGGTTCATCGATGATGGGATAGCGGTTC CATTAGTTTGTTGGCGGGGTAACGGCCACAAGGCAACGATGCAGTAGGGGGATGAGGTGTCTGAGAGGAAGATCCCC... |
| Bacteroides_xylaniso ivens_XB1AT_NCBI _AM230650 | Bacteroides_xylani solvens | AM230650 | SEQ ID NO: 58 | CATGCAAGTCGAGGGGCAGCATTTAGTTTGCTTGCAAACTAAAGATGGCGACCGGCGTGAGTAACACGTATC CAACCTGCCGATAATCTCGGGGATAGCCTTTCGAAAGAAAGATTAATATCCGATAATATATCCGATTAAATAAACCGCTAGGTTTTACTA TTAAAGAATTTCGATGTATCGGATGGAACTAGTTTGTTGGCGGGATAACGGCCCACAAGACTACGATGGA TAGGGGTTCTGAGAGAAGGTCCCCACATTTGTGAACTCCTACGGGAGGCAGCAGAGAA AGTTACTAACAGGTCATGCGACTGTTAGCGTCGAAATGTGAAGGCAGCTACCTGGCGACAGGATGCT GCACGGGCCCTTAGCTCGTAAGGGTAAAAGCTAATGATGAAGCTGGAAGCTGAAGCTGAATAATGCGCATC AATCCCAAAAAACCCCGTAGCGCGACCTAATACGTTCGACGCCCGTCAAGCACATGAAGCAAGCATGAAGGT ACGTAACGCCAAGGAGCGTCCTAGGGTAAACTGGTAATTCGGGCTTAACGGTACAGCCGAAGGT CGGCTG |

FIG. 16X

| | | | |
|---|---|---|---|
| Barnesiella_intestini hominis_ATCC_210 32_NCBI_AB370251 | Barnesiella_intesti nihominis | AB370251 | SEQ ID NO: 59 | AAAGTGTGGGTATCAAACAGGATTAGATACCCTGGTAGTCCACACAGTAAACGATGAATACTCGCTGTTTGCGATATACA GTAAGCGGCCAAGCGAAAGCATTAAGTATTCCACCTGGGAGTACGCCGGCAACGGTGAAACTCAAAGGAATTGACGG GGGCCCGCACAAGCGGAGGAACATGTGGTTTAATTGATGATACGCGAGGAACCTTACCCGGGCTTAAATTGCAAATGA ATAATCTCGAAAGAGATAGCGCAAGGTTAGCCGCAAGGACCATTTGTGAAGGTGCTGCATGCAGGTTGGAGGAACTGA GCTTAAGTGCCATAAGAGCGCAATAACGAGGCCCTTAGTTACTAACAGGTTATGCTGAGGACTCTAGAGAGACTGCCGTCG TAAGATGTGAGGAAGGTCTGGCAGCAGCTACCTGCGACATGAGGATGATGAAGACCCTACACACGGTGTTACAATGGG GGTACAGAAGCAGCTACCTGCGATTCGTAGTGCAAGCGGATGAATGCGACATCAGCCATGAAGACGTCGGAATCGCTAGTAACGC CTTCGTGAAGCTGGATTCGCTAGTAATGCGACGGTGAATACGTTCCCGGGCCTTGTACACACCGC CCGTCAAGCCATGAAAGCCGGGG |
| Bifidobacterium_adol escentis_ATCC_157 03_NCBI_AP009256 | Bifidobacterium_a dolescentis | AP009256 | SEQ ID NO: 60 | GATGAACGCTAGCGACAGGCCTAACACATGCAAGTCGAACGGGTGAGTAACACGTATGCAATCTACC TGTAACAGGGGATAACCCGGAGAAATCCGGACTAATACCGGATGATCCCATATTAAAGTTGGTTACAGACGAGCATGCGTCCAT TAGCCAGTTGGCGGGGTAAGGCCTACCAAGGCGACGACGGGTAGCCGGCCTGAGAGAGGAGCTCGCGTCTGATTAGGTAGTTGGTGGGGTAAAAGCCTACCAAGCCGACGATCGGTAGCCGGCCTGAGAGAGTGAAC TGAGACACGGTCCAAATCCTACGGGAGGCAGCAGTGGGGAATATTGCACAATGGGCGAAAGCCTGATGCAGCGACGCCGCGTGAGGGATGACGGCCTTCGGGTTGTAAACCTCTTTCAGCAGGGAAGAAGCGAGAGTGACGGTACCTGCAGAAGAAGCACCGGCTAACTACGTGCCAGCAGCCGCGGTAATACGTAGGGTGCAAGCGTTATCCGGAATTATTGGGCGTAAAGGGCTCGTAGGCGGTTCGTCGCGTCCGGTGTGAAAGTCCATCGCTTAACGGTGGATCCGCGCCGGGTACGGGCGGGCTTGAGTGCGGTAGGGGAGACTGGAATTCCCGGTGTAGCGGTGGAATGCGCAGATATCGGGAAGAACACCAATGGCGAAGGCAGGTCTCTGGGCCGTCACTGACGCTGAGGAGCGAAAGCGTGGGGAGCGAACAGGATTAGATACCCTGGTAGTCCACGCCGTAAACGGTGGATGCTGGATGTGGGGCCCGTTCCACGGGTTCCGTGTCGGAGCTAACGCGTTAAGCATCCCGCCTGGGGAGTACGGCCGCAAGGCTAAAACTCAAAGAAATTGACGGGGGCCCGCACAAGCGGCGGAGCATGCGGATTAATTCGATGCAACGCGAAGAACCTTACCTGGGCTTGACATGTTCCCGACGGTCGTAGAGATACGGCTTCCCTTCGGGGCGGGGGTCACAGGTGGTGCATGGCTGTCGTCAGCTCGTGTCGTGAGATGTTGGGTTAAGTCCCGCAACGAGCGCAACCCTCGTCTGTGTTGCCAGCATTCAGTTGGGCACTCTACAGAGACTGCCGGTGACAAACCGGAGGAAGGTGGGGATGACGTCAGATCATCATGCCCCTTACGTCCAGGGCTTCACGCATGCTACAATGGCCGGTACAACGGGATGCGACGCGGTGACGTGGAGCGGATCCCTAAAAGCCGGTCTCAGTTCGGATCGCAGTCTGCAACTCGACTGCGTGAAGGCGGAGTCGCTAGTAATCGCGAATCAGCAACGTCGCGGTGAATGCGTTCCCGGGCCTTGTACACACCGCCCGTCAAGTCATGAAAGTGGGCAGCACCCGAAGCCGGTGGCCCAACCCTTGTGGAGGGAGCCGTCGAAGGTGGGACTGGTGATTGGGACTAAGTCGTAACAAGGTAGCCGTACCGGAAGGTGCGGCTGGATCACCTCCTTTCT |

FIG. 16Y

| | | | |
|---|---|---|---|
| Bifidobacterium_adol escentis_H1_NCBI_ JN020353 | Bifidobacterium_a dolescentis | JN020353 | SEQ ID NO: 61 | AGGACGCTGGCGGCGTGCTTAACACATGCAAGTCGAACGGGATCCCAGGAGCTTGCTCCTGGGTGAGAGTGGCGAACGG<br>GTGAGTAATGCGTGACCGACCTGCCCCATACACCGGAATAGCTCCTGGAAACGGGTGGTAATGCCGGATGCTCCAGACA<br>TGACCATGTCGTGTGTGAAAGATTTATCGCTGAAAGAGGGGCTCGCGTCTATCAGCTTGATGGCGGGGTAAGGCGGC<br>CCACCATGCCTTCGACGGGTAGCCGGCCTGAGAGGGTGAACGGCCACATTGGGACTGAGATACGGCCCAGACTCCTA<br>CGGGAGGCAGCAGTGGGGAATATTGCACAATGGGCGAAAGCCTGATGCAGCGACGCCGCGTGTGGGATGAAGGCCTT<br>CGGGTTGTAAACCGCTTTTGATCATGGACGAAGTGTGAGTGACGGTACCTGCAGAAGAAGGACCGGCTAACTACGT<br>GCCAGCAGCCGCGGTAATACGTAGGGTGCAAGCGTTATCCGGAATTATTGGGCGTAAAGGGCTCGTAGGCGGTTCGTC<br>GCGTCCGGTGTGAAAGTCCATCGCTTAACGGTGGATCTGCGCCGGGTACGGGCGGGCTTGAGTGCGGTAGGGGAGAC<br>TGGAATTCCCGGTGTAACGGTGGAATGTGTAGATATCGGGAAGAACACCAATGGCGAAGGCAGGTCTCTGGGCCGTCA<br>CTGACGCTGAGGAGCGAAAGCGTGGGGAGCGAACAGGATTAGATACCCTGGTAGTCCACGCCGTAAGGTGGAACGC<br>GATGTGGGGACCATTCCACGTCCGTCGCGCCGCAGCTAACGCATTAAGTCACCCCGCCTGGGGAGTACGGCCGCAAG<br>GCTAAAACTCAAAGAATTGACGGGGCCCGCACAAGCGGCGAGGATGGTGAGTATGACAAGAACCGC<br>TTACGGCCTTGACATGTTCCGACAGCCGCAGAGATGCGGTTTCCCTTCGGGGACGGAATGACAGGGTGGTGCATGGT<br>CGTCGTCAGCTCGTGTCGTGAGATGTTGGGTTAAGTCCCGCAACGAGCGCAACCCCTCTGTTGTTGCCAGCATCAT<br>GGTGTGGGAACTCACCAGGGTCAACTGGGACTACAAACACCGATATGACGTCCAGTAATCGCGGATCAGCAAGCCG<br>CGGTGAATGCGTTCCCGGGCCTTGTACACACCGCCCGTCAAGTCATGAAAGTGGGTAGCACCCGAAGCCGGTGGCCCA<br>ACCCTTTTGGGAGGGAGCCGTCTAAGGTGAGGCTCGCGATTGGGACTAAGTCCGAACAAGGTGTCCGTAATCGTGCAATCAGCCATGTC<br>ACCTTTTGGAGGGTTCGCATTCTGCCTCAGGATGAACGCTGGCGGCGTGCTTAACACATGCAAGTCGAACGGGATCCCAGG |
| Bifidobacterium_adol escentis_L2_32_NC BI_AAXD02000018 | Bifidobacterium_a dolescentis | AAXD02000001 8 | SEQ ID NO: 62 | TTTTTGTGGAGGGTTCGCATTCTGCCTCAGGATGAACGCTGGCGGCGTGCTTAACACATGCAAGTCGAACGGGATCCCAAG<br>GAGCTTGCTCCTGGGTGAGAGTGGCGAACGGGTGAGTAATGCGTGACCGACCTGCCCCATACACCGGAATAGCTCCTG<br>GAAACGGGTGGTAATGCCGGATGCTCCAGTTGGGGAAAGATTCATCGCTATCAGCTTGATGGCGGGGTATGGGATGCG<br>CGTCCTATCAGCTTGATGGCGGGGTAAGGCGGCCCACCATGCCTTCGACGGGTAGCCGGCCTGAGAGGGTGAACGGCCA<br>CATTGGGACTGAGATACGGCCCAGACTCCTACGGGAGGCAGCAGTGGGGAATATTGCACAATGGCGAAGGCAAGCCTGATG<br>CAGCGACGCCGCGTGTGGGGATGAAGGCCTTCGGGTTGTAAACCGCTTTGACTGGGGGAATACGCGGGCGGTCGGCAAGGT<br>GTACCTTTTCGAATAAGGGGCCTCGTCTTAGGTGGCCAGCAACGTGCAGGCCAGCGCGGTAATACGTAGGGTGCAAGCGTTATCCGGAATTA<br>ACGGAGGCGTTGAGTGCGTTAGGGGTGTGGGAAGACTCAGTCACACCCGGGGAATGGTGTAAGTCGCTGATGCCGAAGAAGACAC<br>CAATGGCGAAGGCAGGTCTCTGGGCCGTCACTGACGCTGAGGAGCGAAAGCGTGGGGAGCGAACAGGATTAGATACC<br>CTGGTAGTCCACGCCGTAAACGGTGGATGCTGGTGAATGCGTTGGTGTGCAAGAAACTTACCCTGGGCCTCGCACTGAGCCCAGCAATCGGCAACGCCAACCGCCGTTCC<br>TGCGGATTAATTCGATCAACGCCGAAGAACCTTACCTGGGCTTGACATGTTCCCGAGATCTGTGAGACGATGCAAGAGATCGCATGGG<br>TTCGGGGACCTCAGTTCGGGAGGATCGGATGCGTGATCGCCTGCAATCAGCCTCGCAGCGCTGATGTCGCTGAAGTCCCGCAACGAGCGCACCCTCGCCGCTGCCAGGCGAAATGGCCGCGTGAACAACGCGCCGCTGCCAGCGTGAACGCGGTGGAAAACTCACCCTTTAAAGCCCGGCAACCCTCGTGTTGCCAGCA<br>GCAACCCCTCGCCGTCAGTTGCCACGAGTGAGCGATCATCATGGGACGATGCAACGCCGGTCACTCCGCAACGGCCACCCTGCTGGGGCTGATGCCACTGGCGGCCAAGCCGGGAAAGTCGCGCCACACTCGAGTAGCGGCCTGAACTCGAAGAAGTGCGCCCATGGCGAAGGCAGGTCTCTGGGCCGTCACCGAAGGCGAAAGCATCAAGAATGGGCATCACGATGATCGCCACCTGGCTTGCACTCGACTCGTGTTTGCAAGGCGCCGGTGCGGGGAAGATATGTGCCAACGATGCCCGAACCTCGAGGAAGTCGCTTAAGCCCCGCCAATGGCGAAAGATGATGCATGCCGCTCAACTCGGAGGAAGGTGCGCCCTAAGCCGCCGCCCGTCCAGCTGAATGCGTCAGCTGGAATCAGCCGCATGCCTCGCGTCAGCCGAATGCCGGAGGAGCCCTAACCTGCCAATGCCCGAACCTCGAGGAAGTCGCTTAAGCCCCGCCAACTGGGCGAACCCTCAAGAAGTGCGCCATATCGAAGTAAGAATCCATCCCGGAGTGGGTCGATAGAACGTGCCCGAACCTCGAGGAAGTCGCTTAAGCCCGCCAACTGGGCGAACCCTCAATGACCCGGAAGCTTAACCGGTCAACTCGGAGAAGCGGGCGACATCCTGGATCTCAGGTAAGGACCGCAGTCCCGTCAGGGCCGAAGGTCCGTGCCAACTGGGCGAACCTGAATCTGTGAGACAGCCTCGCGTCAGCCGAACGGGCACCCGCATCGAGGGCAGCTGTCCGGCACCCTCGCTCGGCCCACTGGGCGCGTAGGCCGCGCCACACTGAGCCGCCACGAATCGAGCCCAATTGCAGCCACTCAGCCCGACTCACTCAGGCCGGAGTCGACAACCTCCCCTCTGCCCACCCTCCCCTCCCCCATACCTGCCTAACCTGCCCCTCCCCTCCCGACATCGCCCTCGCACCCCGACTCGCTCGTCACCCTCACCCGCCCCTCCCCCATCCGCCCCCTCCCCCCCCCC<br>ACCTCCGCCGTCAGTTCGCCACTCATGAGTCGGGTTAAGTCCCGCAACGAGCGCAACCCTCGTCCTCTGTTGCCAGCATTCAGTTGGGCACTCTAAAGACGCCGGTGACAAACCGGAGGAAGGCGGGGATGACGTCAAGTCATGAACCGGGAGCCTTCCCGACTGGCCTGCCAGCATCAACGATTCAGGGCCTGGAATACCTGCCGCACGCCGCCCGTCAACGCCGCCAGGGCAACCGCCTGACTTTCACCCGAAGGGGCTTCCCGCCTTTAAGGCAACCCGTGGGTTCACGGCTATAACGCCAATCCCATCCGCCTGGCGGCTCACCTGCCTCCTGCGCCTTCACCCCCCGCCCCAAGGGCGCCGACCTGCCTGGGAATCCTCTGCTGGATAAGAACCGGATCGAACACCCCTTGGAGAAGGGGATGACCCGAACTCCTGCCCCGAACGACGTGCCTTTGATCCTTCGATCGAAGGTGGATCCCCGAACTCCTGCCCCGAACGACGTGCCTTTGATCCTTCGATCGAAGGTGGATCCCCGAACTCCTGCCCCGAACGACGTGCCTTTGATCCTTCGATCGAAGGTGGATCCCCGAACTCCTGCCCCGAACGACGTGCCTTTGATCCTTCGATCGAAGGTG<br>ACCTTTTGGGAGGGAGCCGTCTAAGGTGGGGCTAGCGATTGGGACTAAGTCCGAACAAGGTGTCCGTAATCGTGAATTGATTGGGAG |
| Bifidobacterium_adol escentis_NCBI_AY3 05304 | Bifidobacterium_a dolescentis | AY305304 | SEQ ID NO: 63 | GATGAACGCTGGCGGCGTGCTTAACACATGCAAGTCGAACGGGATCCCAAGGAGCTTGCTCCTGGGTGAGAGTGGCGAACGGTAATGCGTGACCGACCTGCC<br>CCATACACCGGAATAGCTCCTGGAAACGGGTGGTAATGCCGGATGCTCCAGTTGGGAAAGATTCATCGGCCACATTGGG<br>ACTGAGATACGGCCCAGACTCCTACGGGAGGCAGCAGTGGGGAATATTGCACAATGGGCGCAAGCCTGATGCAGCGAC<br>GCCGCGTGCGGGATGAAGGCCTTCGGGTTGTAAACCGCTTTCGCTTGGGAATAAGGGCTTCGGCTTGACTTACGAAC<br>GGCTAACTACGTGCCAGCAGCCGCGGTAATACGTAGGGTGCAAGCGTTATCCGGAATTATTGGGCGTAAAGGGCTCGT<br>AGGCGGTTCGTCGCGTCCGGTGTGAAAGTCCATCGCTTAACGGTGGATCCGCGCCGGGTACGGGCGGGCTTGAGTGC<br>GGTAGGGGAGACTGGAATTCCCGGTGTAACGGTGGAATGTGTAGATATCGGGAAGAACACCAATGGCGAAGGCAGGTC<br>TCTGGGCCGTCACTGACGCTGAGGAGCGAAAGCGTGGGGAGCGAACAGGATTAGATACCCTGGTAGTCCACGCCGTAAAC |

FIG. 16Z

| | | | |
|---|---|---|---|
| Bifidobacterium_angulatum_DSM_20098_NCBI_ABYS02000004 | Bifidobacterium_angulatum | ABYS02000004 | SEQ ID NO: 64 | GGTGGATGCTGGGATGTCGTGTCGGAGGCAACGCGTTAAGCATCCGCCTGGGAGTCAACGCAAGG CTAAAACTCAAAGAAATTGACGGGGCCCCGCACAAGCGGCGGAGCATGTGGCTTAATTCGATGCAAGCGCGAAGAACCT TACCTGGCCTTGACATGCACAGGTGGTGCCAGAATGGTCGTCGTGTGTCGAGATGTTGGGTTAAGTCCCGCAAC GAGCGCAACCCTCGTCGTTGCCAGCACGTGGGAACTCACCGGGACGGCCCGGGGTCAACGCAAGGAAGGTGG GGATGACGTCAGATCATCATGCCCCTTACGTCCAGGGCTTCACGCATGCTACAATGGCCGGTACAACGGGGATGACGTCAGATCATGCCCCTTCCGTCTCAGTGGAGCGGATCGCAGTCTCAACATGGAGTCAAGCCTTGGTGAATGGTGACACCGACACC ATCCCGAGCAGCGGGTGCCCAGGGACCGTCTCAAGGTGAGACTCGTGATTGGG |
| | | | SEQ ID NO: 64 | TTTTTGTGAGAGGTTCGATTCGGCTCAGGATGAACGCTGGCGGCGTGCTTAACATGAAGTCGAACGCTGGCTGGCGGCT GGAGCTTGCTCCGGCGTGATAGCCGGATGGTCCATGGAAGGGGAATGACCGACCTGCAGTGATGGTCTGGGAAAGATTTATCGGTATGGGATGGG CTGGAAACGGGTGGTAATGCCGGATGCTCCAGTCGCATGGTGTCTGGGAACCTGATACCGCATGGCCTGAGAGGGGACCG GCCACATTGGGACTGAGATACGGCCCAGAGCCTGATGGGAATATTGCACAATGGCCTGAGAGGACCT GATGCAGCGACGCCGTGCGGAGATGACGGCCTAACTACGTGCCAGCAGCCGCGGTAATACGCCGCGGTTAATACGCCGGGTGAAAGTCCATCGGCGTTATCGGGTGA GTGTACCCTTCGAATAAGAGCTCGTAGGCGGTTCGTCGCGTCCGGTGTGAAATCCCCGGTGTAAACGGGTGAAATTCCCGGCGGTTGTCGCGGTTTGGAAGAA TATTGGGCGTAAAGAGCTTGTAGGCGGTTCGTCGCGTCCGGTGTGAAATCCCCGGTGTAAACGGGTGAAATTCCCGGCGGTTGTCGCGGTTTGGAAGAA CACCAATGGCGAAGGCAGCAGGGAGGCAACGGAGCAGCTCTACGACGCGAAGGCGGGTTACTGGAATGGCGGTGATAGGATTAGATA CCCTGGTAGTCCACGCCGTAAACGGTGGATGCTGGATGTGGGGGCCCATTCCACGGGTTCCGTGTCGGAGCTAACGCGT TAAGCATCCCGACCTGGGGAGTACGGCCGCAAGGTTAAAACTCAAATGAATTGACGGGGGCCCGCACAAGCGGCGGAGCATGTGGCTTAATTCGATGCAACGCGAAG AACCTTACCAGGTCTTGACATCCCGAAACCGGTCAGAGATGGGCCTTTCCCTTCGGGGCAGCGGTGACAGGTGGTGCATGGTTGCATGTGGTGGTGTCGTCAGCTCGTCAGATGTTGGGTGTTCGATGTTGCAGCTCAGCTAGTGTCGTCAGCTCGTGTCGTGAGATGTTGGG TTAAGTCCCGCAACGAGCGCAACCCCGTGCCAGCAGCCGCGGTAAGTTCACGCGATCATCATGCCCCTTACGTCCAGGGCTTCACGCATGCTACAATGGCCGGTACAACGGGATGCGACAAGCGCCGCGGTAATACGTAGGGGGCAACGGCGGTGACCGTTAACGCGATCATGCCCCTTACGTCCAGGGCTTCACGCATGCTACAATGGCCGGTACAACGGGATGCGACAAGCGCCGCGGTAATACG GCGAACACCTCCGGCCCCCTGTCGCGGGATGGATGGCTGGCTTGTAACGAGCGCTGCCCAGTCCGGAACTCGGAGGAAG GTGGGGATGACGTCAAGTCATCATGCCCCTTATGACCTGGGCTACACACGTGCTACAATGGCCGGTACAACGGGATGCGACAAGCGCCGCGGTACAACGGGATGCGACAAGCGCCGCGGTACAACGGGATGCGACAAGCGCCGCGGTAATACG GAAGTGGTAGCTAATCAGCAACATGCTGTCAGTTCGGATTGTAGTCTGCAACTCGACTACATGAAGCTGGAATCGCTAGTAATCGCGGATCAGCATGCCGCGGTGAATACGTTCCCGGGCCTTGTACACACCGCCCGTCACACCATGGGAGTTGGGAGTCACAGGTTAAGTCGTAACAAGGTAGCCGTACCGGAAGGTGCGGCTGGATCACCTCCTTTCT |
| Bifidobacterium_angulatum_YL1_NCBI_AB489094 | Bifidobacterium_angulatum | AB489094 | SEQ ID NO: 65 | GAGAGTTTCGGTTCGGCTCAGGATGAACGCTGGCGGCGTGCTTAACATGCAAGTCGAACGGATCCGACAAGCTTG CTTGTCGATGAGAGTTGGCGAACGGGTGAGTAATGCGTGACCGACCTGCCCCATACGGGTATGGAATAGCCTCCTGGAAACGG GTCTAATACCGGATGCTCCAGTCGCATGGTGTCTGGGAAAGATTTCATCGGTATGGGATGGGCCCGCGTCCT ATCAGGTAGTGTGGTCATGCGGCCACCGACGAGCATGGCAGCGCATCGGGGAATATTGGGTACACAATGCGACGA GACTGAGATACGGCCAGACCCCTAGGGAATACAGAGCACCGGGGTAATAACGGCTGCCAAGCGCCCGCAGCGGAAGCGGCGGCCTGAGTGGGAGCGGCAAGCTAACCGGGTATATCGGGTA CGCCCGCGCTGTGCGGGATGACGGCCTAACTACGTGCCAGCAGCCGCGGGTAATACGGAGGGTGCAAGCGTTATCGGAATTATTGGGCGTAAAGAGGCT TAAGCACCGGGTAGGCGGTTCGTCGCGTCTGGTGTGAAAGGCCGGGGCTCAACCCCGGGACTGCACTTCGAACTGCCA AGGCTCTCTGGGCGCTGGAGTACGGTAGGGGAGACTGGAATTCCTGGTGGTGGTAAGCGGTGAAATGCGTAGATATCAGGAAG AACACCAGTGGCGAAGGCGGTCTGCTCGGTGATGGCCCTGACGCTAGGGCAGCAACGGAATTAGATACCCTGGTAGTCCA CGGAGTAAACGATGAATGCTAGGTGTCGGGTAAGTCTACGACCCGCCCGGAGCGGCCTGAGGCCGCCAAGCGTAACGCGGATTA AGCATTCCGCCTGGGGAGTACGGCCGCAAGGCTAAAACTCAAAGAATTGACGGGGGCCCGCACAAGCGGCGGGAGCATGTGGCTTAATTCGAT GCAACGCGAAGAACCTTACCAGGTCTTGACATGTTGACCAACGGTTCAGAGATGGACTTCCCTCTTCTCGGAGTGGCGTCAGATCATGATCATCATGCCCCTTACGGAGTGGTGCATCGGTGTCGTCAGCTCGTGTCGTGAGATGTTGGGTTAAGTCCCGCAACG AGCGCAACCCTCGCCGCAGCGTAAACGAGCGTGGTTTATCCGGTTCAGTGTTGCAGCGCCGCCACCCTGACGTCGTAGAGAT GGTGGGGGATGACGTCAAGTCCATGCATCCATGCCCCTTATGTCCAGGGCTTCACACATGCTACAATGGCCGGTACAACGGGATGCAACATGGAGATCGCGAGACCGCGAGGTCGAGCAAGCCTAGGTGACAAGGCCCGGCAGCGTCGCGTACTCCGCGAGCCGCTGACAGACTGCAATCGCCGGCTCTTTCGTAAGCCGTAAGGTCCGGCCCCCGTTACACACCGCCCGTCACACCATGGGAGTTGGGAGTGACTGAGATACG TCATCATCGGAGTCGGATAACCGGTCTCAGTTCGGATCGAGGTCTGCAACCCGACTCCGTGAAGCTGGAATCGCTAGTAATCGCGGATCAGCATGCCGCGGTGAATACGTTCCCGGGCCTTGTACACACCGCCCGTCACACCATGGGAGTTGGGAGTCACAGAATCGAGGAAG |
| Bifidobacterium_animalis_f1_NCBI_JN020359 | Bifidobacterium_animalis | JN020359 | SEQ ID NO: 66 | GTCGGAGGTGGTCTGAGAGTTCGGAGCTGGACCGCGCACGAACCGCAAACGCAAGAGCGCGAACCGGAATAGCTCCTCAGGAAACGG GTGGTAATACCGGATGCTCCGCCCCTGCCATGGGAGCGGCGGGAAAGATGCTTTGCCCATGGGATGGGGTCGCGTCC TATCAGCTTGTTGGTGAGGGTAATGGCTCACCAAGGCGATGATGGGTAGCCGGCCTGAGAGGGTGACCGGCCACATTG |

FIG. 16AA

| | | | | |
|---|---|---|---|---|
| | | | | GGACTGAGATACGGCCCAGACTCCTACGGGAGGCAGCAGTGGGGAATATTGCACAATGGGCGCAAGCCTGATGCAGCGACGCCGCGTGCGGGATGGAGGCCTTCGGGTTGTAAACCGCTTTTGTTCAAGGGCAAGGCACGGTTTCGGCCGTGTTGAGTGGATTGTTCGAATAAGCACCGGCTAACTACGTGCCAGCAGCCGCGGTAATACGTAGGGTGCGAGCGTTATCCGGATTTATTGGGCGTAAAGGGCTCGTAGGCGGTTCGTCGCGTCCGGTGTGAAAGTCCATCGCCTAACGGTGGATCTGCGCCGGGTACGGGCGGGCTGGAGTGCGGTAGGGGAGACTGGAATTCCCGGTGTAACGGTGGAATGGCGGGCTGGAGTGCGGTAGGGGAGACTGGAATTCCCGGTGTAACGGTGGAATGTGTAGATATCGGGAAGAACACCAATGGCGAAGGCAGGTCTCTGGGCCGTCACTGACGCTGAGGAGCGAAAGCGTGGGGAGCGAACAGGATTAGATACCCTGGTAGTCCACGCCGTAAACGGTGGATGCTGGATGTGGGGCCCTTTCCACGGGTCCCGTGTCGGAGCCAACGCGTTAAGCATCCCGCCTGGGGAGTACGGCCGCAAGGCTAAAACTCAAAGAAATTGACGGGGGCCCGCACAAGCGGCGGAGCATGCGGATTAATTCGATGCAACGCGAAGAACCTTACCTGGGCTTGACATGTGCCGGATCGCCGTGGAGACACGGTTTCCCTTCGGGGCCGGTTCACAGGTGGTGCATGGTCGTCGTCAGCTCGTGTCGTGAGATGTTGGGTTAAGTCCCGCAACGAGCGCAACCCTCGCCGCATGTTGCCAGCGGGTGATGCCGGGAACTCATGTGGGACCGCCGGGGTCAACTCGGAGGAAGGAGGGGATGACGTCAGATCATCATGCCCCTTACGTCCAGGGCTTCACGCATGCTTCAATGGCCGGTACAACGCGGTGCGACACGGTGACGTGGGGCGGATCGCTGAAAACCGGTCTCAGTTCGGATCGCAGTCTGCAACTCGACTGCGTGAAGGCGGAGTCGCTAGTAATC |
| Bifidobacterium_animalis_JSQ1_NCBI_DQ295042 | Bifidobacterium_animalis | DQ295042 | SEQ ID NO: 67 | CAAGTCGAACGGGATCCCTGGCAGCTTGCTGTCGGGGTGAGAGTGGCGAACGGGTGAGTAATGCGTGACCAACCTGCCCTGTGCACCGGAATAGCTCCTGGAAACGGGTGGTAATACCGGATGCTCCGCTCCATCGCATGGTGGGGTGGGAAATGCTTTTGCGGCATGGGATGGGGTCGCGTCCTATCAGCTTGTTGGCGGGGTGATGGCCCACCAAGGCGTTGACGGGTAGCCGGCCTGAGAGGGTGACCGGCCACATTGGGACTGAGATACGGCCCAGACTCCTACGGGAGGCAGCAGTGGGGAATATTGCACAATGGGCGCAAGCCTGATGCAGCGACGCCGCGTGCGGGATGGAGGCCTTCGGGTTGTAAACCGCTTTTGTTCAAGGGCAAGGCACGGTTTCGGCCGTGTTGAGTGGATTGTTCGAATAAGCACCGGCTAACTACGTGCCAGCAGCCGCGGTAATACGTAGGGTGCGAGCGTTATCCGGATTTATTGGGCGTAAAGGGCTCGTAGGCGGTTCGTCGCGTCCGGTGTGAAAGTCCATCGCCTAACGGTGGATCTGCGCCGGGTACGGGCGGGCTGGAGTGCGGTAGGGGAGACTGGAATTCCCGGTGTAACGGTGGAATGTGTAGATATCGGGAAGAACACCAATGGCGAAGGCAGGTCTCTGGGCCGTCACTGACGCTGAGGAGCGAAAGCGTGGGGAGCGAACAGGATTAGATACCCTGGTAGTCCACGCCGTAAACGGTGGATGCTGGATGTGGGGCCCTTTCCACGGGTCCCGTGTCGGAGCCAACGCGTTAAGCATCCCGCCTGGGGAGTACGGCCGCAAGGCTAAAACTCAAAGAAATTGACGGGGGCCCGCACAAGCGGCGGAGCATGCGGATTAATTCGATGCAACGCGAAGAACCTTACCTGGGCTTGACATGTGCCGGATCGCCGTGGAGACACGGTTTCCCTTCGGGGCCGGTTCACAGGTGGTGCATGGTCGTCGTCAGCTCGTGTCGTGAGATGTTGGGTTAAGTCCCGCAACGAGCGCAACCCTCGCCGCATGTTGCCAGCGGGTGATGCCGGGAACTCATGTGGGACCGCCGGGGTCAACTCGGAGGAAGGTGGGGATGACGTCAGATCATCATGCCCCTTACGTCCAGGGCTTCACGCATGCTACAATGGCCGGTACAACGCGGTGCGACACGGTGACGTGGGGCGGATCGCTGAAAACCGGTCTCAGTTCGGATCGCAGTCTGCAACTCGACTGCGTGAAGGCGGAGTCGCTAGTAATCGCGGATCAGCAACGCCGCGGTGAATGCGTTCCCGGGCCTTGTACACACCGCCCGTCAAGTCATGAAAGTGGGTAGCACCCGAAGCCGGTGGCCCGACCCTTGTGG |
| Bifidobacterium_animalis_subsp_lactis_AD011_NCBI_CP001213 | Bifidobacterium_animalis | CP001213 | SEQ ID NO: 68 | TTTTTGTGGAGGGTTCGATTCTGGCTCAGGATGAACGCTGGCGGCGTGCTTAACACATGCAAGTCGAACGGGATCCCTGGCAGCTTGCTGTCGGGGTGAGAGTGGCGAACGGGTGAGTAATGCGTGACCAACCTGCCCTGTGCACCGGAATAGCTCCTGGAAACGGGTGGTAATACCGGATGCTCCGCTCCATCGCATGGTGGGGTGGGAAATGCTTTTGCGGCATGGGATGGGGTCGCGTCCTATCAGCTTGTTGGCGGGGTGATGGCCCACCAAGGCGTTGACGGGTAGCCGGCCTGAGAGGGTGACCGGCCACATTGGGACTGAGATACGGCCCAGACTCCTACGGGAGGCAGCAGTGGGGAATATTGCACAATGGGCGCAAGCCTGATGCAGCGACGCCGCGTGCGGGATGGAGGCCTTCGGGTTGTAAACCGCTTTTGTTCAAGGGCAAGGCACGGTTTCGGCCGTGTTGAGTGGATTGTTCGAATAAGCACCGGCTAACTACGTGCCAGCAGCCGCGGTAATACGTAGGGTGCGAGCGTTATCCGGATTTATTGGGCGTAAAGGGCTCGTAGGCGGTTCGTCGCGTCCGGTGTGAAAGTCCATCGCCTAACGGTGGATCTGCGCCGGGTACGGGCGGGCTGGAGTGCGGTAGGGGAGACTGGAATTCCCGGTGTAACGGTGGAATGTGTAGATATCGGGAAGAACACCAATGGCGAAGGCAGGTCTCTGGGCCGTCACTGACGCTGAGGAGCGAAAGCGTGGGGAGCGAACAGGATTAGATACCCTGGTAGTCCACGCCGTAAACGGTGGATGCTGGATGTGGGGCCCTTTCCACGGGTCCCGTGTCGGAGCCAACGCGTTAAGCATCCCGCCTGGGGAGTACGGCCGCAAGGCTAAAACTCAAAGAAATTGACGGGGGCCCGCACAAGCGGCGGAGCATGCGGATTAATTCGATGCAACGCGAAGAACCTTACCTGGGCTTGACATGTGCCGGATCGCCGTGGAGACACGGTTTCCCTTCGGGCCGGTTCACAGGTGGTGCATGGTCGTCGTCAGCTCGTGTCGTGAGATGTTGGGTTAAGTCCCGCAACGAGCGCAACCCTCGCCGCATGTTGCCAGCGGGTGATGCCGGGAACTCATGTGGGACCGCCGGGGTCAACTCGGAGGAAGGTGGGGATGACGTCAGATCATCATGCCCCTTACGTCCAGGGCTTCACGCATGCTACAATGGCCGGTACAA |

FIG. 16AB

| | | | |
|---|---|---|---|
| Bifidobacterium_ani malis_subsp_lactis_ BB_12_NCBI_GU11 6483 | Bifidobacterium_a nimalis | GU116483 | SEQ ID NO: 69 | CGCGGGTGCGCGACACGGTGACGTGGGGCGGAGATCGCTCAGTTCGGATCGCAGTCGCAACTCGACTGC<br>GTGAAGGCGAGTCGCTAGTAATGCGGATCAGCAATGCCGCGGTGAATGCGTTCCCGGGCCTTGTACACACCGCC<br>GTCAAGTCATGAAAGTGCTAGTAAGCCCGGAAGCCGGTGGCCGACCCTTGTGGGGGAGCCGTCTAAGGTGAGACTCG<br>TGATTGGGACTAAGTCGTAACAAGGTAGCCGTACCGGAAGGTGCGGCTGGATCACCTCCTTTCT |
| Bifidobacterium_ani malis_subsp_lactis_ Bl_07_NCBI_CP003 498 | Bifidobacterium_a nimalis | CP003498 | SEQ ID NO: 70 | GAACGCTGGCGGCGTGCTTAACACATGCAAGTCGAACGGGATCCCTGCTGCGTCCCAGCTTGCTGGGATCG<br>CGGGTGAGAGTGGCGAACGGGTGAGTAATGCGTGACCAACGTGCCCTTGCACCGTGTGGGATCCTGGAAACGGGTG<br>GTAATACCGGATGCTCCGCTCCATCGCAAGGGTTGACGGTGAAATGCTTTTGCGGGCATGGATGCTCGGGTCCTATC<br>AGCTTGTTGGCGGGGTAAGGCCTACCAAGGCGATGACGCGGTAGCCGGCCTGAGAGGGTGAACGGCCACATTGGGAC<br>TGAGATACGGCCCAGACTCCTACGGGAGGCAGCAGTGGGGAATATTGCACAATGGGCGCAAGCCTGATGCAGCGACG<br>CCGCGTGCGGGATGAAGGCCTTCGGGTTGTAAACCGCTTTCAGCAGCGGAAGACCGCGGTTCGGGCGTTATCCGGATTTAT<br>GATTGTTCGAATAAGGGCTGGAGTGCAAGCTGGCGCCTGTAGGGGTTCGTCGCGGTTGTGCCGGTGAATTCGGGTAT<br>TGGGCAGGCTGAAGGTACGGGTAAGACTGGGGGCCCGTTAAGCCGGTGCCCGTTGAAAGTGTAAGGTACCGAGAAAGTGCCTAAGACACC<br>CAATGAAGCCAGGGCAGGTCTGCGGGCTCGCGCTAAAACTGTGGAACATGTTAGGGCGAAAGAGGATTAGATACC<br>CTGGTAGTCCACGCCGTGCTCGGGAGTACGGCCGCAAGGCTAAAACCCAAGAATTGACTGAGAATTAGATACC<br>AGCATCCCGCCTAATTCGATGCAACCCTGGCGGCGGCTCAACAGCTTACCTGTCGCGCAAGCTGAACAGGTTGGGGCACATGCCGTCCGC<br>TTCGGGAGCTGCGGGATGCACACGTGAGGCAACGTCAGGCAACCCTGGCCTGGAGGCACGGGAGCACGGGAGCATTTGCACCATCCTGG<br>GAACCCTGCCGGTTGCAGCCGGGTGATGCCGTCAAGGGTTGTGGTCCGAGGGCTTCATGCCCCGGATTCCGACGCCGAC<br>GATTGTTCGGAATAAGGCCAGGCTAACTACGTGCCAGCAGCCGCGGTAAACCGCGGGTAAATGCGGATGCCAACTA<br>CGGGTAGTAATCGGGATCAGCAACGCCGCGGTGTGGCCGGATGACGGCTAACTACGTGCCAGCAGCCGCGGTAAACGCGGGTAAATGCGGATGCCAACTACGTGCCAGCAGCCGC<br>AAGTGGTAACAAGGTAGCCGTACCGGAAGGTGCGGCTGGATCACCTCCTTT |
| Bifidobacterium_ani malis_subsp_lactis_ Bl_04_NCBI_CP001 515 | Bifidobacterium_a nimalis | CP001515 | SEQ ID NO: 71 | TTTTGTGAGGGTTCGATTCTGGCTCAGGATGAACGCTGCGGCGCGTGCTTAACACATGCAAGTCGAACATGCCCCTG<br>GCAGCTTGCTGTCCGGGGTGAGAGTGGCGAACGGGTGAGTAATGCGTGACCAACCTGCCCCTGTGACCGCATGGGATAGCCTCC<br>TGGGAAACGGGTGGTAATACCGGATGCTCCATCGCAAGGGTTGGGTCATGCCCATGGAGGGTGACCGG<br>TCGCGTCCTATCATCAGCTTGTTGGCGGGGTGATCGGCCACCAAGGCGATGACGGGTAGCCGGCCTGAGAGGGTGACCGG<br>CCACATTGGGACTGAGATACGGCCCAGACTCCTACGGGAGGCAGCAGTGGGGAATATTGCACAATGGGCGCAAGCCTG |

FIG. 16AC

| | | | |
|---|---|---|---|
| Bifidobacterium_animalis_subsp_lactis_CNCM_I_2494_NCBI_CP002915 | CP002915 | SEQ ID NO: 72 | ATGCAGCGAGCGCCGCGTGCCGGATGGAGGCCTTCGGGGTTGTAAACCGCTTTGTTCAAGGGCAAGGCACGGTTTCGGC<br>CGTGTTGAGTGGATTGTTCGGCGTAGCTGCCAGCAGCTGCATCGTAATACGTAGGGTGCGAGCGTT<br>ATCCGGAATTATTGGGCGTAAAGCGCTCGTAGGCGGTTCGTCGCGTCCGGTGTGAAAGTCCATCGCTTAACGGTGGAT<br>CTGCGCCGGGTACGGGCGGGCTGGAGTGCGGTAGGGGAGAGTGGAATTCCTGGTGTAGCGGTGAAATGCGTAGATAT<br>CGGAAGAACACCAATGGCGAAGGCAGCTCTCTGGGCCGTCACTGACGCTGAGGAGCGAAAGCGTGGGGAGCGAACA<br>GGATTAGATACCCTGGTAGTCCACGCCGTAAACGGTGGATGCTGGATGTGGGGCCCTTTCCACGGGTCTCCGTGTCGGA<br>GCCAACGCGTTAAGCATCCCGCCTGGGGAGTACGGCCGCAAGGCTAAAACTCAAAGAAATTGACGGGGGCCCGCACAA<br>GCGGCGGAGCATGCGGATTAATTCGATGCAACGCGAAGAACCTTACCTGGTCTTGACATGTGTCAGCTCGGTCCGTGGAGAG<br>ACACGGTTTCCCTTCGGGGACAGGCCGACAGGTGGTGCATGGTTGTCGTCAGCTCGTGTCGTGAGATGTTGGGTTAAGT<br>CCCGCAACGAGCGCAACCCTCGCCGTGATGTTGGGGACTCATGCATGACTGCCGGTGACAAATCCGGAGGAAGGTGGG<br>GATGACGTCAAATCATCATGCCCCTTATGACCTGGGCTACACCGTGTACTACAATGGCCGGTACAACGGGATGCCAACTC<br>GCGAGGGGAAGCGAATCGCTAGTAATCGCGGATCAGCAACGCCGCGGTGAATGCGTTCCCGGGCCTTGTACACACCGCCC<br>GTCAAGTCATGAAAGTGGGTAAGCCCGAAGGCGTACCGTAACAAGTGGGCTGGAGCGGTGCCGAAGGTGAGGCTAAT<br>GATTGGGACTAAGTCGTAACAAGGTAGCCGTACCGGAAGGTGCGGCTGGATCACCTCCTTCTACGGAGA |
| Bifidobacterium_animalis_subsp_lactis_DSM_10140_NCBI_CP001606 | CP001606 | SEQ ID NO: 73 | AGGGTTCGATTCTGGCTCAGGATGAACGCTGGCGGCGTGCTTAACACATGCAAGTCGAACGGGATCCTGCAGCTTG<br>CTGTCGGGTGAGAGTGGCGAACGGGTGAGTAATGCGTGACCAACCTGCCCTTGTGCACCGGAATAGCTCCTGGAAACG<br>GGTGTAATACCGGATATCTCCCGGTGATCCGCCATCGCGGAAATGTTTGCGCCATGGATGGGCTCCGCGTCTGATTAGC<br>TATCAGCTTGTTGGTGAGGTAATGGCTCACCAAGGCGTTGACGGGTAGCCGGCCTGAGAGGGTGACCGGCCACAATTG<br>GGACTGAGATACGCCCCAGACTCCTACGGGAGGCAGCAGTGGGGAATATTGCACAATGGGCGCAAGGCTGAAAGCGC<br>AGTGGATTATGCTGCCGCGTGAGGGATGAAGGCTGCCGCTTGGGCGGCGGACGGATGACCTAACCGGCTTCAGCCCGGATCG<br>TTTATTGGCTGGCGGCTAAAGGGCCTCTAGGGCGGTTCGTCGCGTCCGGTGTGAAAGTCGCCCGCCTAACGGGGCTGC<br>GGGGTCGGCGGCGGCGGTGGAGTGGCTGGAGTGCCAGGCATGCCAGGTCTCGCGGCGAATTCCCGGGTGGCGGCGG<br>AACACCAATGGCGAAGGCAGCCGGCCAGGCTGAGGTGATCGGCCTAAAAGCAGTGAGTGGGGAGCAACACGGATTAG<br>ATACCCTGGTAGTCCACGCCGTAAACGGTGGATGCTGGATGTGGGGGTCCCTTCCACGGGATCCGTGTCGGAGCCAACG<br>CGTTAAGCATCCCGCCTGGGGAGTACGGCCGCAAGGCTGAAACTCAAAGAAATTGACGGGGGCCCGCACAAGCGGCGG<br>AGCATGCGGATTAATTCGATGCAACGCGAAGAACCTTACCTGGGCTTGACATGTTGCCGGATCGCCGGAGAGATCGGC<br>TTTCCCTTCGGGGCAACGGCCACAGGTGGTGCATGGTTGTCGTCAGCTCGTGTCGTGAGATGTTGGGTTAAGTCCCGCAA<br>CGAGCGCAACCCCTGCCGCATCATGTTGCCAGCACGGTGATGTCCGGTGAATGCCGGGGTGACAAATCCGGAGGAAGG<br>AAGGTGGGGATGACGTCAAATCATCATGCCCCTTATGACCTGGGCTACACACGTACTACAATGCCGGTGACAACGGG<br>ATGCAATGCTCGCGAGAGCGAGCGAATCGCTAGTAATCGTAATCAGCAACATTGACGGTGAATGCGTTCCCGGGCCTTGTAC<br>ACACCGCCCGTCAAGTCATGAAAGTGGGTAACACCTGAGACCGGATGTCAAGAGGTGGTGGGCATGATTAGGGGGAAT<br>GACTAAGTCGTAACAAGGTAGCCGTACCGGAAGGTGCGGCTGGATCACCTCCTT |

| | | | | |
|---|---|---|---|---|
| | | | | GACACGGTTTCCCTTCGGGGCCGGTTCACAGGTGGTGCATGGTCGTCGTCAGCTCGTGTCGTGAGATGTTGGGTTAAG<br>TCCCGCAACGAGCGCAACCCTCGCCGCATGTTGCCAGCGGGTGATGCCGGGAACTCATGTGGGACCGCCGGGGTCAA<br>CTCGGAGGAAGGTGGGGATGACGTCAGATCATCATGCCCCTTACGTCCAGGGCTTCACGCATGCTACAATGGCCGGTA<br>CAACGCGGTGCGACACGGTGACGTGGGGCGGATCGCTGAAAACCGGTCTCAGTTCGGATCGCAGTCTGCAACTCGACT<br>GCGTGAAGGCGGAGTCGCTAGTAATCGCGGATCAGCAACGCCGCGGTGAATGCGTTCCCGGGCCTTGTACACACCGC<br>CCGTCAAGTCATGAAAGTGGGTAGCACCCGAAGCCGGTGGCCCGACCCTTGTGGGGGGAGCCGTCTAAGGTGAGACT<br>CGTGATTGGGACTAAGTCGTAACAAGGTAGCCGTACCGGAAGGTGCGGCTGGATCACCTCCTTTCTACGGAGA |
| Bifidobacterium_ani malis_subsp_lactis_ LCR22_NCBI_HQ25 9732 | Bifidobacterium_a nimalis | HQ259732 | SEQ ID NO: 74 | TCTGGCTCAGGATGAACGCTGGCGGCGTGCTTAACACATGCAAGTCGAACGGGATCCCTGGCAGCTTGCTGTCGGGGT<br>GAGAGTGGCGAACGGGTGAGTAATGCGTGACCAACCTGCCCTGTGCACCGGAATAGCTCCTGGAAACGGGTGGTAATA<br>CCGGATGCTCCGCTCCATCGCATGGTGGGGTGGGAAATGCTTTTGCGGCATGGGATGGGGTCGCGTCCTATCAGCTTG<br>TTGGCGGGGTGATGGCCCACCAAGGCGTTGACGGGTAGCCGGCCTGAGAGGGTGACCGGCCACATTGGGACTGAGAT<br>ACGGCCCAGACTCCTACGGGAGGCAGCAGTGGGGAATATTGCACAATGGGCGCAAGCCTGATGCAGCGACGCCGCGT<br>GCGGGATGGAGGCCTTCGGGTTGTAAACCGCTTTTGTTCAAGGGCAAGGCACGGTTTCGGCCGTGTTGAGTGGATTGT<br>TCGAATAAGCACCGGCTAACTACGTGCCAGCAGCCGCGGTAATACGTAGGGTGCGAGCGTTATCCGGATTTATTGGGC<br>GTAAAGGGCTCGTAGGCGGTTCGTCGCGTCCGGTGTGAAAGTCCATCGCCTAACGGTGGATCTGCGCCGGGTACGGG<br>CGGGCTGGAGTGCGGTAGGGGAGACTGGAATTCCCGGTGTAACGGTGGAATGTGTAGATATCGGGAAGAACACCAATG<br>GCGAAGGCAGGTCTCTGGGCCGTCACTGACGCTGAGGAGCGAAAGCGTGGGGAGCGAACAGGATTAGATACCCTGGT<br>AGTCCACGCCGTAAACGGTGGATGCTGGATGTGGGGCCCTTTCCACGGGTCCCGTGTCGGAGCCAACGCGTTAAGCAT<br>CCCGCCTGGGGAGTACGGCCGCAAGGCTAAAACTCAAAGAAATTGACGGGGGCCCGCACAAGCGGCGGAGCATGCGG<br>ATTAATTCGATGCAACGCGAAGAACCTTACCTGGGCTTGACATGTGCCGGATCGCCGTGGAGACACGGTTTCCCTTCGG<br>GGCCGGTTCACAGGTGGTGCATGGTCGTCGTCAGCTCGTGTCGTGAGATGTTGGGTTAAGTCCCGCAACGAGCGCAAC<br>CCTCGCCGCATGTTGCCAGCGGGTGATGCCGGGAACTCATGTGGGACCGCCGGGGTCAACTCGGAGGAAGGTGGGGA<br>TGACGTCAGATCATCATGCCCCTTACGTCCAGGGCTTCACGCATGCTACAATGGCCGGTACAACGCGGTGCGACACGG<br>TGACGTGGGGCGGATCGCTGAAAACCGGTCTCAGTTCGGATCGCAGTCTGCAACTCGACTGCGTGAAGGCGGAGTCGC<br>TAGTAATCGCGGATCAGCAACGCCGCGGTGAATGCGTTCCCGGGCCTTGTACACACCGCCCGTCAAGTCATGAAAGTG<br>GGTAGCACCCGAAGCCGGTGGCCCGACCCTTGTGGGGGGAGCCGTCTAAGGTGAGACTCGTGATTGG |
| Bifidobacterium_ani malis_subsp_lactis_ V9_NCBI_CP00189 2 | Bifidobacterium_a nimalis | CP001892 | SEQ ID NO: 75 | TTTTTGTGGAGGGTTCGATTCTGGCTCAGGATGAACGCTGGCGGCGTGCTTAACACATGCAAGTCGAACGGGATCCCTG<br>GCAGCTTGCTGTCGGGGTGAGAGTGGCGAACGGGTGAGTAATGCGTGACCAACCTGCCCTGTGCACCGGAATAGCTCC<br>TGGAAACGGGTGGTAATACCGGATGCTCCGCTCCATCGCATGGTGGGGTGGGAAATGCTTTTGCGGCATGGGATGGGG<br>TCGCGTCCTATCAGCTTGTTGGCGGGGTGATGGCCCACCAAGGCGTTGACGGGTAGCCGGCCTGAGAGGGTGACCGG<br>CCACATTGGGACTGAGATACGGCCCAGACTCCTACGGGAGGCAGCAGTGGGGAATATTGCACAATGGGCGCAAGCCTG<br>ATGCAGCGACGCCGCGTGCGGGATGGAGGCCTTCGGGTTGTAAACCGCTTTTGTTCAAGGGCAAGGCACGGTTTCGGC<br>CGTGTTGAGTGGATTGTTCGAATAAGCACCGGCTAACTACGTGCCAGCAGCCGCGGTAATACGTAGGGTGCGAGCGTT<br>ATCCGGATTTATTGGGCGTAAAGGGCTCGTAGGCGGTTCGTCGCGTCCGGTGTGAAAGTCCATCGCCTAACGGTGGAT<br>CTGCGCCGGGTACGGGCGGGCTGGAGTGCGGTAGGGGAGACTGGAATTCCCGGTGTAACGGTGGAATGTGTAGATAT<br>CGGGAAGAACACCAATGGCGAAGGCAGGTCTCTGGGCCGTCACTGACGCTGAGGAGCGAAAGCGTGGGGAGCGAACA<br>GGATTAGATACCCTGGTAGTCCACGCCGTAAACGGTGGATGCTGGATGTGGGGCCCTTTCCACGGGTCCCGTGTCGGA<br>GCCAACGCGTTAAGCATCCCGCCTGGGGAGTACGGCCGCAAGGCTAAAACTCAAAGAAATTGACGGGGGCCCGCACAA<br>GCGGCGGAGCATGCGGATTAATTCGATGCAACGCGAAGAACCTTACCTGGGCTTGACATGTGCCGGATCGCCGTGGAG<br>ACACGGTTTCCCTTCGGGGCCGGTTCACAGGTGGTGCATGGTCGTCGTCAGCTCGTGTCGTGAGATGTTGGGTTAAGT<br>CCCGCAACGAGCGCAACCCTCGCCGCATGTTGCCAGCGGGTGATGCCGGGAACTCATGTGGGACCGCCGGGGTCAAC<br>TCGGAGGAAGGTGGGGATGACGTCAGATCATCATGCCCCTTACGTCCAGGGCTTCACGCATGCTACAATGGCCGGTAC<br>AACGCGGTGCGACACGGTGACGTGGGGCGGATCGCTGAAAACCGGTCTCAGTTCGGATCGCAGTCTGCAACTCGACTG<br>CGTGAAGGCGGAGTCGCTAGTAATCGCGGATCAGCAACGCCGCGGTGAATGCGTTCCCGGGCCTTGTACACACCGCCC<br>GTCAAGTCATGAAAGTGGGTAGCACCCGAAGCCGGTGGCCCGACCCTTGTGGGGGGAGCCGTCTAAGGTGAGACTCG<br>TGATTGGGACTAAGTCGTAACAAGGTAGCCGTACCGGAAGGTGCGGCTGGATCACCTCCTTTCT |

FIG. 16AE

| | | | |
|---|---|---|---|
| Bifidobacterium_ani malis_YIT_4121_NC BI_AB050136 | Bifidobacterium_a nimalis | SEQ ID NO: 76 | AGTTTGATCATGGCTGCGGCGTGCTTAACACATGCAAGTCGAACGGGATCCCTGGCAGCTTGCT GTCGGGTGAGAGTGGCGAACGGGTGAGTAATGCGTGACCAACCTGCCCTGTGACCGGGGGATAACAGTTGGAAACGG GTGGTAATACCGGATGCTCCGCTCCATCGCATGGTGGGGGTGGAAATGCTTTTGCGGTGTGGGATGGGGTCCT ATCAGCTTGTTGGCGGGGTGATGGCCCACCAAGGCGTTGACGGTAGCAACGGCCTGAGAGGGTGACCGGCCACATTGG GACTGAGATACCGGCCCAGACTCCTACGGGAGGCAGCAGTGGGGAATATTGCACAATGGGCGCAAGCCTGATGCAGCGA CGCCGCGTGCGGGATGACGGCCTTCGGGTTGTAAACCGCTTTCAAGGGCAAGGCACGTTTCGGTGCCGGTATCCGGATT TGGATGTTTCGAATAAGGACCGGCTAACTACGTGCCAGCAGCCGCGGTAATACGTAGGGTGCAAGCGTTATCCGGATT ATTGGGCGTAAAGGGCTCGTAGGCGGCTCGTCGCGTCGTGGTGAAAGTCCATCGCTTAACGGTGGATCGCCGCGGG TACGGGCGGGCTGGAGTGCGGTAGGGGAGACTGGAATTCCTGGTGTAGCGGTGAAATGCGTAGATATCGGGAAGAACA CCAATGGCGAAGGCAGGTCTCTGGGCCGTAAACGGTGGATGCCCGGGGCCCTCCACGTGCCGGGCAACGCCTTAGTGCCGGAGCCAACGCGTT AAGCATCCCGGCTCCTGGGGAGCAAAAGACTAAATCCAAAGAATTGACGGGGGCCCGCACAAGCGGCGGAGC ATGTGGATTAATTCGATGCAACGCGAAGAACCTTACCGGCTTGACATGTCGGGGAATTCGCGAGATTGTGG AGCATCCCGGATCCTGGTGACAAAGGTGCGCATGGCTGTCGTCAGCTCGTGTCGTGAGATGTTGGGTTAAGTCCCGCAAGTGAGCGCAAC CCCTTGTCCGGGGAATCAGCAACGGGGCCAACCTTGTCCAGGCCTCAAGCGCGGGGTTAATCCAAGAGGTAGCAAGCGGTAAGCGTTAC ATCCCGGGTTAAGTCCCGCAACGAGCGCAACCCCTCGTTGCCAGCATTCAGTTGGGCACTCTGGCGGGGACTGCCGGTGACAAACCGGAGGAAGGCGGGGATGACGTCAAGTCATCATGCCCCTTATGACCTGGGCTACACACGTACTACAATCCGGGAGACAGAGGGCCGCAAGACCGCGAGGTTAGCCACATCCTGAAAACCCCGGTCCCAGTTCAGATTGCAGGCTGCAACTCGCCTGCATGAAGTCGGGAATTGCTAGTAATCGCGAATCAGCAACGCGCGGTGAATACGTTCCCGGGCCTTGTACACACCGCCCGTCAAGTCATGAAAGTGGGCAGCGGCCGAAGGCCGGACCGCGGCCCGTCAAGTCATGAAAGCGCCTAAGGTAACCCTTGTGAAGCGGGCTGCGGAAGGGCGTGAAGAGCCGGTCAGGACTGGGACT |
| Bifidobacterium_bifid um_CECT_7366_NC BI_HM590860 | Bifidobacterium_bif idum | SEQ ID NO: 77 | CAGTGCAACGGGATCCATGGGGGCTTGCTTGGTGGTGAGTAATGCGTGACCAACCTGCCCC ATGCCCGGGATTAGTCCTGGAAACGGGTGCTAATACCGGATGTTCCACATGACCCGCATGGTGTGTGGGAAAGATTCT ATCGGCCACCGGAGCGTCTTACCGGTCTATCAGCGTTGTGAGGTAACGGCTTCGAGGGGTCGGCCGG CTGAGAGGGTGACCGGGCCACAGGGGACTGAGATACGGCCCAGACTCCTACGGGAGGCAGCAGTGGGAATATTGCA CAATGGGCGCAAGCCTGATGCAGCGACGCCGCGTGAGGGATGAAGGCCTTCGGGTTGTAAACCTCTTTGTAATCGCGGGGGGGGGAGAACAGAGGCCGCGGGGAGGGGCGTACGGCGGGGGTGGGGCCGGCCGGCGTAAGAGTGCGCTGGGGGCCGGCGGCGGCGGCGTACGTAGCGGTAGGGGAGACTGGGACT |
| Bifidobacterium_bifid um_DSM_20456_N CBi_U25952 | Bifidobacterium_bif idum | SEQ ID NO: 78 | GATGAACGCTGGCGGCGTGCTTAACACATGCAAGTCGAACGGGATCATCAAGCTTGCTTGGTGGTGAGTGGCGAA CGGGTGAGTAATGCGTGACCGACCTGCCCCATGCCCGGGATATGCCTTGGAAACGGGGTGCTAATAACCGGATGTTCCA CATGATCGCATGGTCTGATGGAAAGTCCATGGGGGGGCTAGGGGGAATATTGGGGGGGCGCACAAGCCCGAGTAAC |

FIG. 16AF

| | | | |
|---|---|---|---|
| Bifidobacterium_bifid um_NCIMB_41171_NCBI_ABQP010000 27 | Bifidobacterium_bif idum | ABQP0100000 2 7 | SEQ ID NO: 79 | CTGACGCTGAGGAGGCTGGGAGAGCGAAACAGGATTAGATACCCTGGTAGTCCACGCCGTAAACGGTGGATGCT<br>GGATGTGGGGGCACGTTCCACGTGTTCCGTGTGAGAGCGTCGGCAGCGCCAAGAGCTCAAAG<br>GCTAAAACTCAAAGAAATTGACGGGGCCCGCACAAGCGGTGGAGCATGTGGATTAATTCGATGCAACGCGAAGAACC<br>TTACCTGGGCTTGACATGTTCGTGAGATGTTCCCTTCGGGGCGGTTCCCAGAGTGGTGCATGG<br>CGTCGTCAGCTCGTGTCGTGAGATGTTGGGTTAAGTCCCGCAACGAGCGCAACCCTCGCCCCGTGTTGCCAGCACGTT<br>ATGGTGGGAACTCACGGGAGACTGCCGGCGATCAAGTCGGAGGAAGGTGGGGATGACGTCAGATCATCATGCCCCTTAC<br>GTCCTCAGTTCGGATCGGAGTACACACGTGCTACAATGGCCGGTACAATGGGAAGCGACCTCGTGAGGGTGAGCGGATCCTAGTAATCGCGGATCAGCAACGCCG<br>CGGTGAATGCGTTCCCGGGCCTTGTACACACCGCCCGTCAAGTCATGAAAGTGGGACTACCCGAAGCCCGTGCAGTAACCCG<br>ACCCCTTGTGAGGATGGAGCGCCGTCAAGGTGAGGGGCTAACCAAGGTAGTCGTAACAAGGTAGCCGTACCGGAAGG<br>TGCGGCTG |
| Bifidobacterium_bifid um_PRL2010_NCBI _CP001840 | Bifidobacterium_bif idum | CP001840 | SEQ ID NO: 80 | TTTTTGTGGAAGGTTCGATTCTGGCTCAGGATGAACGCTGGCTGTAACACATGCAAGTCGAAGCGGATCCATC<br>AAGCTTGCTTGGTGGTGAGAGTGCGGCAACGGGTGAGTAATGCGTGACCGACCTGCCCCATGCTCGGAATAGCTCCTG<br>GAAACTGGGGTGGTAATGCCGGATGTTCCACATGATGGCATGTGAGGAAAGATTCTATCGGCGTGGGAATGGGGACCGGC<br>GCGTCCTATCAGCTTGTTGGTGAGATACGGCCCAGACTCCTACGGGAGGCAGCAGTGGGGAATATTGCACAATGGGCGCAAGCCTGAT<br>ACATTGGGACTGAGATAAGGCCCGGCTAACTACGTGCCAGCAGCCGCGGTAAAACGTCTTTGTTTGGGAGCAAGCCTTCGGGTTGAGTGT<br>ACCTTTCGAATAAGCACCGGCTAACTACGTGCCAGCAGCCGCGGTAATACGTAGGGGTGCAAGCGTTATCCGGATTTATT<br>GGGCGTAAAGGGCTCGTAGGCGGTGAGGTGCGGTAGGGAGTGCTCTCGGAGGATCGGCGAATGGAAGCGAAGGTGCGTTCCCGCGGAGGTAATGGGCCTAACCGGCCTAGTAATGCCGATCAAGCCAGTAGAGCCCGCAACCCGGCCGTAACCGGAGGTGGA<br>CGGAACCCTGCCCCAGGCTACGGCGTACGGCCTAACTACGTGCCAGCAGCCGCGGTAATACGTAGGGGTGCAAGCGTTATCCGGATTTATT<br>GGGCGTAAAGGGCTCGTAGGCGGTGAGGTGCGGTAGGGAGTGCTCTCGGAGGATCGGCGAATGGAAGCGAAGGTGCGTTCCCG<br>CTGGTAGTCCACGCCGTAAACGGTGGATGGCTAGGTGTGGGGACGCGAAAGCCGAAATAGCGCCGTTA<br>AGCGGCGGAAGGGGACCGCCTGGGGCAGTACGGCCGCAAGGCTAAAACTCAAATGAATTGACGGGGGCCCGCACAAGCGGAGCA<br>TGCGGATTAATTCGATGCAACGCGAAGAACCTTACCTGGGCTTGACATGTTCCCGACGACGTTGGGTAACCGGTACGGAGG<br>GGGATGACGTCAGATCGCGGATCATCATCGCCCCTTACGTCCCTTGATCCGTCAGTTCCAGGAAACCGCTACAATGGCCGATACAATGGGAAGCAACCGCGTAAGCAACCGCTGAGGAGGACCGCTACAATGGCCGATACAATGGGAAGCAACCGCTGAGGAGGACCGCTACAATGGCCGATACAATGGGAAGCAACCGCGTAAGCTGAGCGGATCAGGAGG<br>CATGCCGCGGTGAATGCGTTCCCGGGCCTTGTACACACCGCCCGTCAAGTCATGGGAGTGGGCGCTAGAGTCGGA<br>CCAACCCGGAGGGCGCTAACCAAGGTAGTCGTTAACCGGTTACCGTACGGAGCGCTGAGGAGCCGGCTGAGG |

FIG. 16AG

| | | | | |
|---|---|---|---|---|
| | | | | AGTCGCTAGTAATCGCGGATCAGCAACGCCGCGGTGAATGCGTTCCCGGGCCTTGTACACACCGCCCGTCAAGTCATGAAAGTGGGCAGCACCCGAAGCCGGTGGCCTAACCCCTTGTGGGATGGAGCCGTCTAAGGTGAGGCTCGTGATTGGGACTAAGTCGTAACAAGGTAGCCGTACCGGAAGGTGCGGCTGGATCACCTCCTTTCT |
| Bifidobacterium_bifidum_R0071_NCBI_GU936674 | Bifidobacterium_bifidum | GU936674 | SEQ ID NO: 81 | GATCCATCGGGCTTTGCTTGGTGGTGAGAGTGGCGAACGGGTGAGTAATGCGTGACCGACCTGCCCCATGCTCCGGAATAGCTCCTGGAAACGGGTGGTAATGCCGGATGTTCCACATGATCGCATGTGATTGTGGGAAAGATTCTATCGGCGTGGGATGGGGTCGCGTCCTATCAGCTTGTTGGTGAGGTAACGGCTCACCAAGGCTTCGACGGGTAGCCGGCCTGAGAGGGCGACCGGCCACATTGGGACTGAGATACGGCCCAGACTCCTACGGGAGGCAGCAGTGGGGAATATTGCACAATGGGCGCAAGCCTGATGCAGCGACGCCGCGTGAGGGATGGAGGCCTTCGGGTTGTAAACCTCTTTTGTTTGGGAGCAAGCCTTCGGGTGAGTGTACCTTTCGAATAAGCGCCGGCTAACTACGTGCCAGCAGCCGCGGTAATACGTAGGGCGCAAGCGTTATCCGGATTTATTGGGCGTAAAGGGCTCGTAGGCGGCTCGTCGCGTCCGGTGTGAAAGTCCATCGCTTAACGGTGGATCTGCGCCGGGTACGGGCGGGCTGGAGTGCGGTAGGGGAGACTGGAATTCCCGGTGTAACGGTGGAATGTGTAGATATCGGGAAGAACACCGATGGCGAAGGCAGGTCTCTGGGCCGTCACTGACGCTGAGGAGCGAAAGCGTGGGGAGCGAACAGGATTAGATACCCTGGTAGTCCACGCCGTAAACGGTGGACGCTGGATGTGGGGCACGTTCCACGTGTTCCGTGTCGGAGCTAACGCGTTAAGCGTCCCGCCTGGGGAGTACGGCCGCAAGGCTAAAACTCAAAGAAATTGACGGGGGCCCGCACAAGCGGCGGAGCATGCGGATTAATTCGATGCAACGCGAAGAACCTTACCTGGGCTTGACATGTTCCCGACGACGCCAGAGATGGCGTTTCCCTTCGGGGCGGGTTCACAGGTGGTGCATGGTCGTCGTCAGCTCGTGTCGTGAGATGTTGGGTTAAGTCCCGCAACGAGCGCAACCCTCGCCCCGTGTTGCCAGCACGTTATGGTGGGAACTCACGGGGGACCGCCGGGGTTAACTCGGAGGAAGGTGGGGATGACGTCAGATCATCATGCCCCTTACGTCCAGGGCTTCACGCATGCTACAATGGCCGGTACAGCGGGATGCGACATGGCGACATGGAGCGGATCCCTGAAAACCGGTCTCAGTTCGGATCGGAGCCTGCAACCCGGCTCCGTGAAGGCGGAGTCGCTAGTAATCGCGGATCAGCAACGCCGCGGTGAATGCGTTCCCGGGCCTTGTACACACCGCCCGTCAAGTCATGAAAGTGGGCAGCACCCGAAGCCGGTGGCCTAACC |
| Bifidobacterium_bifidum_S17_NCBI_CP002220 | Bifidobacterium_bifidum | CP002220 | SEQ ID NO: 82 | TTTTTGTGGAGGGTTCGATTCTGGCTCAGGATGAACGCTGGCGGCGTGCTTAACACATGCAAGTCGAACGGGATCCATCGGGCTTTGCTTGGTGGTGAGAGTGGCGAACGGGTGAGTAATGCGTGACCGACCTGCCCCATGCTCCGGAATAGCTCCTGGAAACGGGTGGTAATGCCGGATGTTCCACATGATCGCATGTGATTGTGGGAAAGATTCTATCGGCGTGGGATGGGGTCGCGTCCTATCAGCTTGTTGGTGAGGTAACGGCTCACCAAGGCTTCGACGGGTAGCCGGCCTGAGAGGGCGACCGGCCACATTGGGACTGAGATACGGCCCAGACTCCTACGGGAGGCAGCAGTGGGGAATATTGCACAATGGGCGCAAGCCTGATGCAGCGACGCCGCGTGAGGGATGGAGGCCTTCGGGTTGTAAACCTCTTTTGTTTGGGAGCAAGCCTTCGGGTGAGTGTACCTTTCGAATAAGCGCCGGCTAACTACGTGCCAGCAGCCGCGGTAATACGTAGGGCGCAAGCGTTATCCGGATTTATTGGGCGTAAAGGGCTCGTAGGCGGCTCGTCGCGTCCGGTGTGAAAGTCCATCGCTTAACGGTGGATCTGCGCCGGGTACGGGCGGGCTGGAGTGCGGTAGGGGAGACTGGAATTCCCGGTGTAACGGTGGAATGTGTAGATATCGGGAAGAACACCGATGGCGAAGGCAGGTCTCTGGGCCGTCACTGACGCTGAGGAGCGAAAGCGTGGGGAGCGAACAGGATTAGATACCCTGGTAGTCCACGCCGTAAACGGTGGACGCTGGATGTGGGGCACGTTCCACGTGTTCCGTGTCGGAGCTAACGCGTTAAGCGTCCCGCCTGGGGAGTACGGCCGCAAGGCTAAAACTCAAAGAAATTGACGGGGGCCCGCACAAGCGGCGGAGCATGCGGATTAATTCGATGCAACGCGAAGAACCTTACCTGGGCTTGACATGTTCCCGACGACGCCAGAGATGGCGTTTCCCTTCGGGGCGGGTTCACAGGTGGTGCATGGTCGTCGTCAGCTCGTGTCGTGAGATGTTGGGTTAAGTCCCGCAACGAGCGCAACCCTCGCCCCGTGTTGCCAGCACGTTATGGTGGGAACTCACGGGGGACCGCCGGGGTTAACTCGGAGGAAGGTGGGGATGACGTCAGATCATCATGCCCCTTACGTCCAGGGCTTCACGCATGCTACAATGGCCGGTACAGCGGGATGCGACATGGCGACATGGAGCGGATCCCTGAAAACCGGTCTCAGTTCGGATCGGAGCCTGCAACCCGGCTCCGTGAAGGCGGAGTCGCTAGTAATCGCGGATCAGCAACGCCGCGGTGAATGCGTTCCCGGGCCTTGTACACACCGCCCGTCAAGTCATGAAAGTGGGCAGCACCCGAAGCCGGTGGCCTAACCCCTTGTGGGATGGAGCCGTCTAAGGTGAGGCTCGTGATTGGGACTAAGTCGTAACAAGGTAGCCGTACCGGAAGGTGCGGCTGGATCACCTCCTTTCT |
| Bifidobacterium_breve_ACS_071_V_Sch8b_NCBI_CP002743 | Bifidobacterium_breve | CP002743 | SEQ ID NO: 83 | TTTTTGTGGAGGGTTCGATTCTGGCTCAGGATGAACGCTGGCGGCGTGCTTAACACATGCAAGTCGAACGGGATCCATCGGGCTTTGCCTGGTGGTGAGAGTGGCGAACGGGTGAGTAATGCGTGACCGACCTGCCCCATGCACCGGAATAGCTCCTGGAAACGGGTGGTAATGCCGGATGCTCCATCACACCGCATGGTGTGTTGGGAAAGCCTTTGCGGCATGGGATGGGGTCGCGTCCTATCAGCTTGATGGCGGGGTAACGGCCCACCATGGCTTCGACGGGTAGCCGGCCTGAGAGGGCGACCGGCCACATTGGGACTGAGATACGGCCCAGACTCCTACGGGAGGCAGCAGTGGGGAATATTGCACAATGGGCGCAAGCCTGATGCAGCGACGCCGCGTGAGGGATGGAGGCCTTCGGGTTGTAAACCTCTTTTGTTAGGGAGCAAGGCACTTTGTGTTGAGTGTACCTTTCGAATAAGCACCGGCTAACTACGTGCCAGCAGCCGCGGTAATACGTAGGGTGCAAGCGTTATCCGGAATT |

FIG. 16AH

| | | | |
|---|---|---|---|
| Bifidobacterium_brev e_CECT_7263_NCBI_AFVV01000031 | Bifidobacterium breve | AFVV01000031 | SEQ ID NO: 84 | ATTGGGGCGTAAAGGGCTCGTAGGCGGTTCGTCGCGTCCGGTGTGAAAGTCCATCGCTTAACGGTGGATCCGCGCCGGG TACGGGCGGGCCTTGAGTGCGGTAGGGGAGACTGGAATTCCCGGTGTAGCGGTGGAATGCGCAGATATCGGGAAGAACA CCAATGGCGAAGGCAGGTCTCTGGGCCGTTACTGACGCTGAGGAGCGAAAGCGTGGGGAGCGAACAGGATTAGATAC CCTGGTAGTCCACGCCGTAAACGGTGGATGTGGGGCCCGTTCCACGGGTTCCGTGTCGGAGCTAACGCGTT AAGCATCCCGCCTGGGGAGTACGGCCGCAAGGCTAAAACTCAAAGAAATTGACGGGGGCCCGCACAAGCGGCGGAGC ATGCGGATTAATTCGATGCAACGCGAAGAACCTTACCTGGGCTTGACATGTTCCGACGATCGTCGAGAGATCGGTTTCC CTTCGGGACAGCGGTGACAGGTGGTGCATGGTTGTCGTCAGCTCGTGTCGTGAGATGTTGGGTTAAGTCCCGCAACGAG CGCAACCCTCGCCCCGTGTTGCCAGCAGATTCCGGCTGGGAACTCACGGGGAACCGCCGGTGACAAACCGGAGGAAGG TGGGGATGACGTCAGATCATCATGCCCCTTACGTCGGGAGGCTTCACGCATGCTACAAATGGCCGGTACAACGGGATGCG ACAGTGCGAGCTGGAGCGGATCCGAAAAAGCCGGTCTCAGTTCGGATCGCAGTCTGCAACTCGACTGCGTGAAGTCGGA AGTCGCTAGTAATCGCGAATCAGCAACGTCGCGGTGAATGCGTTCCCGGGCCTTGTACACACCGCCCGTCAAGTCATGA AAGTGGGCAGCACCGCAAGCCGGTGGCCTAACCCCTTGTGGGAAGGAGCCGTCTAAGGTGAGGTCGTGATTGGGAC TAAGTCGTAACAAGGTAGCCGTACCGGAAGGTGCGGCTGGATCACCTCCTTCT |
| | | | |
| Bifidobacterium_brev e_DSM_20213_NCBI_ACCG02000012 | Bifidobacterium breve | ACCG020000012 | SEQ ID NO: 85 | TTTTTGTGGAGGGTTCGATTCGGCTCAGGATGAACGCTGGCGGCGTGCTTAACACATGCAAGTCGAACGGGATCCATC GGGCTTGCCTGGTGGTGAGAGTGGCGAACGGGTGAGTAATGCGTGACCGACCTGCCCCATGCCCGACCTTTGCGCGGATG GGAAACGGGGTGGTAATGCCGGATGCTCCATCACACGCGTTATGTGTTGACGGCATGCGGGCATGGGCGGCCAAGGCCTGAGAGGGGCGACCGGCC ACATTGGGACTGAGATACGGCCCAGAATGCCTACGGGAGGCAGCAGTGGGGAATATTGCACAATGGGCGCAAGCCTGAT GCAGCGACGCCGCGTGAGGGATGAAGGCCTTCGGGTTGTAAACCTCTTTTGTTAGGGAAGAAGCGCAAGGTGTATCGGGTTGTTGAG TGTACCTTTGCGAAAAGGGCTCGTAGGCGGGAGCTCGTAGGCGGTTCGTCGCGTCCGGTGTGAAAGTCCATCGCTTAACGGTGGATCCGCGCCGGG ATTGGGGCGTAAAGGGCTCGTAGGCGGTTCGTCGCGTCCGGTGTGAAAGTCCATCGCTTAACGGTGGATCCGCGCCGGG TACGGGCGGGCCTTGAGTGCGGTAGGGGAGACTGGAATTCCCGGTGTAGCGGTGGAATGCGCAGATATCGGGAAGAACA CCAATGGCGAAGGCAGGTCTCTGGGCCGTTACTGACGCTGAGGAGCGAAAGCGTGGGGAGCGAACAGGATTAGATAC CCTGGTAGTCCACGCCGTAAACGGTGGATGTGGGGCCCGTTCCACGGGTTCCGTGTCGGAGCTAACGCGTT AAGCATCCCGCCTGGGGAGTACGGCCGCAAGGCTAAAACTCAAAGAAATTGACGGGGGCCCGCACAAGCGGCGGAGC ATGCGGATTAATTCGATGCAACGCGAAGAACCTTACCTGGGCTTGACATGTTCCGACGATCGTCGAGAGATCGGTTTGTTGAG TGTACCTTTGCGAATAAGGGCTAACTACGGTGCCAGCAGCCGCGGTAATACGTAGGGTGCAAGCGTTATCCGGAATT ATTGGGCGTAAAGGGCTCGTAGGCGGTTCGTCGCGTCCGGTGTGAAAGTCCATCGCTTAACGGTGATATCGGCGCCGGG TACGGGCGGGCCTTGAGTGCGGTAGGGGAGACTGGAATTCCCGGTGTAGCGGTGGAATGCGCAGATATCGGGAAGAACAC CAATGGCGAAGGCAGGTCTCTGGGCCGTTACTGACGCTGAGGAGCGAAAGCGTGGGGAGCAACAGGATTAGATAC CCTGGTAGTCCACGCCGTAAACGGTGGATGTGGGGCCCGTTCCACGGGTTCCGTGTCGGAGCTAACGCGTT AAGCATCCCGCCTGGGGAGTACGGCCGCAAGGCTAAAACTCAAAGGAATTGACGGGGGCCCGCACAAGCGGCGGAGC ATGCGGATTAATTCGATGCAACGCGAAGAACCTTACCTGGGCTTGACATGTTCCGACGATCGTCGAGAGATCGGTTTGTTGAG CGCAACCCTCGCCCCGTGTTGCCAGCAGATTGTGCCAGCAGCCGCGGTAATACGTAGGGTGCAAGCGTTAATCGGAGGAAGG |

FIG. 16AI

| | | | | |
|---|---|---|---|---|
| | | | | TGGGGATGACGTCAGATCATCATGCCCCTTACGTCCAGGGCTTCACGCATGCTACAATGGCCGGTACAACGGGATGCG<br>ACAGTGCGAGCTGGAGCGGATCCCTGAAAACCGGTCTCAGTTCGGATCGCAGTCTGCAACTCGACTGCGTGAAGGCGG<br>AGTCGCTAGTAATCGCGAATCAGCAACGTCGCGGTGAATGCGTTCCCGGGCCTTGTACACACCGCCCGTCAAGTCATGA<br>AAGTGGGCAGCACCCGAAGCCGGTGGCCTAACCCCTTGCGGGAGGGAGCCGTCTAAGGTGAGGCTCGTGATTGGGAC<br>TAAGTCGTAACAAGGTAGCCGTACCGGAAGGTGCGGCTGGATCACCTCCTTTCT |
| Bifidobacterium_breve_LCR10_NCBI_HQ259719 | Bifidobacterium_breve | HQ259719 | SEQ ID NO: 86 | GATGAACGCTGGCGGCGTGCTTAACACATGCAAGTCGAACGGGATCCATCGGGCTTTGCCTGGTGGTGAGAGTGGCGA<br>ACGGGTGAGTAATGCGTGACCGACCTGCCCCATGCACCGGAATAGCTCCTGGAAACGGGTGGTAATGCCGGATGCTCC<br>ATCACACCGCATGGTGTGTTGGGAAAGCCTTTGCGGCATGGGATGGGGTCGCGTCCTATCAGCTTGATGGCGGGGTAA<br>CGGCCCACCATGGCTTCGACGGGTAGCCGGCCTGAGAGGGCGACCGGCCACATTGGGACTGAGATACGGCCCAGACT<br>CCTACGGGAGGCAGCAGTGGGGAATATTGCACAATGGGCGCAAGCCTGATGCAGCGACGCCGCGTGAGGGATGGAGG<br>CCTTCGGGTTGTAAACCTCTTTTGTTAGGGAGCAAGGCACTTTGTGTTGAGTGTACCTTTCGAATAAGCACCGGCTAACT<br>ACGTGCCAGCAGCCGCGGTAATACGTAGGGTGCAAGCGTTATCCGGAATTATTGGGCGTAAAGGGCTCGTAGGCGGTT<br>CGTCGCGTCCGGTGTGAAAGTCCATCGCTTAACGGTGGATCCGCGCCGGGTACGGGCGGGCTTGAGTGCGGTAGGGG<br>AGACTGGAATTCCCGGTGTAACGGTGGAATGTGTAGATATCGGGAAGAACACCAATGGCGAAGGCAGGTCTCTGGGCC<br>GTTACTGACGCTGAGGAGCGAAAGCGTGGGGAGCGAACAGGATTAGATACCCTGGTAGTCCACGCCGTAAACGGTGGA<br>TGCTGGATGTGGGGCCCGTTCCACGGGTTCCGTGTCGGAGCTAACGCGTTAAGCATCCCGCCTGGGGAGTACGGCCG<br>CAAGGCTAAAACTCAAAGAAATTGACGGGGGCCCGCACAAGCGGCGGAGCATGCGGATTAATTCGATGCAACGCGAAG<br>AACCTTACCTGGGCTTGACATGTTCCCGACGATCCCAGAGATGGGGTTTCCCTTCGGGGCGGGTTCACAGGTGGTGCA<br>TGGTCGTCGTCAGCTCGTGTCGTGAGATGTTGGGTTAAGTCCCGCAACGAGCGCAACCCTCGCCCCGTGTTGCCAGCG<br>GATTGTGCCGGGAACTCACGGGGGACCGCCGGGGTTAACTCGGAGGAAGGTGGGGATGACGTCAGATCATCATGCCC<br>CTTACGTCCAGGGCTTCACGCATGCTACAATGGCCGGTACAACGGGATGCGACAGTGCGAGCTGGAGCGGATCCCTGA<br>AAACCGGTCTCAGTTCGGATCGCAGTCTGCAACTCGACTGCGTGAAGGCGGAGTCGCTAGTAATCGCGAATCAGCAAC<br>GTCGCGGTGAATGCGTTCCCGGGCCTTGTACACACCGCCCGTCAAGTCATGAAAGTGGGCAGCACCCGAAGCCGGTG<br>GCCTAA |
| Bifidobacterium_breve_UCC2003_NCBI_CP000303 | Bifidobacterium_breve | CP000303 | SEQ ID NO: 87 | TTTTTGTGGAGGGTTCGATTCTGGCTCAGGATGAACGCTGGCGGCGTGCTTAACACATGCAAGTCGAACGGGATCCATC<br>GGGCTTTGCCTGGTGGTGAGAGTGGCGAACGGGTGAGTAATGCGTGACCGACCTGCCCCATGCACCGGAATAGCTCCT<br>GGAAACGGGTGGTAATGCCGGATGCTCCATCACACCGCATGGTGTGTTGGGAAAGCCTTTGCGGCATGGGATGGGGTC<br>GCGTCCTATCAGCTTGATGGCGGGGTAACGGCCCACCATGGCTTCGACGGGTAGCCGGCCTGAGAGGGCGACCGGCC<br>ACATTGGGACTGAGATACGGCCCAGACTCCTACGGGAGGCAGCAGTGGGGAATATTGCACAATGGGCGCAAGCCTGAT<br>GCAGCGACGCCGCGTGAGGGATGGAGGCCTTCGGGTTGTAAACCTCTTTTGTTAGGGAGCAAGGCACTTTGTGTTGAG<br>TGTACCTTTCGAATAAGCACCGGCTAACTACGTGCCAGCAGCCGCGGTAATACGTAGGGTGCAAGCGTTATCCGGAATT<br>ATTGGGCGTAAAGGGCTCGTAGGCGGTTCGTCGCGTCCGGTGTGAAAGTCCATCGCTTAACGGTGGATCCGCGCCGGG<br>TACGGGCGGGCTTGAGTGCGGTAGGGGAGACTGGAATTCCCGGTGTAACGGTGGAATGTGTAGATATCGGGAAGAACA<br>CCAATGGCGAAGGCAGGTCTCTGGGCCGTTACTGACGCTGAGGAGCGAAAGCGTGGGGAGCGAACAGGATTAGATAC<br>CCTGGTAGTCCACGCCGTAAACGGTGGATGCTGGATGTGGGGCCCGTTCCACGGGTTCCGTGTCGGAGCTAACGCGTT<br>AAGCATCCCGCCTGGGGAGTACGGCCGCAAGGCTAAAACTCAAAGAAATTGACGGGGGCCCGCACAAGCGGCGGAGC<br>ATGCGGATTAATTCGATGCAACGCGAAGAACCTTACCTGGGCTTGACATGTTCCCGACGATCCCAGAGATGGGGTTTCC<br>CTTCGGGGCGGGTTCACAGGTGGTGCATGGTCGTCGTCAGCTCGTGTCGTGAGATGTTGGGTTAAGTCCCGCAACGAG<br>CGCAACCCTCGCCCCGTGTTGCCAGCGGATTATGCCGGGAACTCACGGGGGACCGCCGGGGTTAACTCGGAGGAAGG<br>TGGGGATGACGTCAGATCATCATGCCCCTTACGTCCAGGGCTTCACGCATGCTACAATGGCCGGTACAACGGGATGCG<br>ACAGCGCGAGCTGGAGCGGATCCCTGAAAACCGGTCTCAGTTCGGATCGCAGTCTGCAACTCGACTGCGTGAAGGCGG<br>AGTCGCTAGTAATCGCGAATCAGCAACGTCGCGGTGAATGCGTTCCCGGGCCTTGTACACACCGCCCGTCAAGTCATGA<br>AAGTGGGCAGCACCCGAAGCCGGTGGCCTAACCCCTTGCGGGAGGGAGCCGTCTAAGGTGAGGCTCGTGATTGGGAC<br>TAAGTCGTAACAAGGTAGCCGTACCGGAAGGTGCGGCTGGATCACCTCCTTTCT |
| Bifidobacterium_catenulatum_ATCC_27539_NCBI_ABXY01000019 | Bifidobacterium_catenulatum | ABXY01000019 | SEQ ID NO: 88 | TTTTTGTGGAGGGTTCGATTCTGGCTCAGGATGAACGCTGGCGGCGTGCTTAACACATGCAAGTCGAACGGGATCCAGG<br>CAGCTTGCTGCCTGGTGAGAGTGGCGAACGGGTGAGTAATGCGTGACCGACCTGCCCCATACACCGGAATAGCTCCTG<br>GAAACGGGTGGTAATGCCGGATGCTCCGACTCCTCGCATGGGGTGTCGGGAAAGATTTCATCGGTATGGGATGGGGTC<br>GCGTCCTATCAGGTAGTCGGCGGGGTAACGGCCCACCGAGCCTACGACGGGTAGCCGGCCTGAGAGGGCGACCGGC |

FIG. 16AJ

| | | | |
|---|---|---|---|
| Bifidobacterium_cate nulatum_KCTC_322 1_NCBI_GU361816 | Bifidobacterium_ca tenulatum | GU361816 | SEQ ID NO: 89 | CACAATTGGGACTGAGATACGGCCCAGACTCCTACGGGAGGCAGCAGTGGGGAATATTGCACAATGGGCGCAAGCCTGA TGCAGCGACGCCGCGTGAGGGATGACGGCCTTCGGGTTGTAAACCGCTTTCAGCAGGGAAGAAGCGAAAGTGACGGTA TACCTTGAATAAGCACCGGCTAACTACGTGCCAGCAGCCGCGGTAATACGTAGGGTGCAAGCGTTATCCGGAATTAT TGGGCGTAAAGGGCTCGTAGGCGGTTCGTCGCGTCCGGTGTGAAAGTCCATCGCTTAACGGTGGATCTGCGCCGGGTA CGGGCGGGGCTGGAGTGCAGTAGGGGAGACTGGAATTCCCGGTGTAACGGTGGAATGTGTAGATATCGGGAAGAACAC CAATGGCGAAGGCAGGTCTCTGGGCTGTCACTGACGCTGAGGAGCGAAAGCGTGGGGAGCGAACAGGATTAGATACC CTGGTAGTCCACGCCGTAAACGGTGGATGCTGGATGTGGGGACGCTGTGTCCGCACCGTCCGTAAGCTGACGCGTTA AGCATCCCGCCTGGGGAGTACGGCCGCAAGGCTAAAACTCAAAGGAATTGACGGGGGCCCGCACAAGCGGCGGAGCA TGCGGATTAATTCGATGCAACGCGAAGAACCTTACCTGGGCTTGACATGTTCGGGAGATCGTGAGATGACACGGAGT TCCCTTCGGGGCGAAACCGACACAGGTGGTGCATGGCTGTCGTCAGCTCGTGTCGTGAGATGTTGGGTTAAGTCCCG CAACGAGCGCAACCCTTGTTGCCCAGCACATCATCATGGGGCCATGATGGGACTCTGCAGAGACTGCCGGGGTCAACT CGGAGGAAGGTGGGGACGACGTCGGATCGTGGGGTGATGACGGTACGGCATCGAGGTAGAAAGCTGCTTTCG AACCACGGCCACACACTAGCCGGATCGCCACCAGCACGCCGAGGTCGTTAAACGGACGCGTTTCCCGTGGGTCGTAGGCGGTTCG GTGCCAGCAGCCGCGGTAATACGCGTAATACGTAGGGTGCAAGCGTTATCGGAATTATTGGGCGTAAAGGGCTCGTAGGCGGTTCG TCGCGTAACGCTTAAACGGTGAAAGCTAACCGCGGAAGCGGCGAGAGTTCCCGGTGTGAAGGCGGCAACCAGCAGGAG ACTGGAATTCGCTGCTAGCGGTAATCGCCGAACCTAGCAGACGGGGAAGACCCTGAAA CCTTACGGTGGAGAAGCGTTCGCGTCCCGGGATCATCGGACCCCTGGGGAGACCGAACGCGTACCGGA TAACCCGTGTGGGATGATGACCGGTTAACCCGACCGCCTGGGAGTACGGTCGCAAGACTGAAACTCAAAGGAATTGAC GGGGGACCCGCACAAGCAGCGGAGCATGTGGCTTAATTCGAAGCAACGCGAAGAACCTTACCAAGGCTTGACATGTTGCCG ACGAACCTGTAAACATAGGTGTCCCCTTCGGGGCTGGTAACAGGTGGTGGCATGGCTGTCGTCAGCTCGTGTCGTGAGATGT TGGGTTAAGTCCCGCAACGAGCGCAACCCTTGTCATAGTTGCCAGCACGTAATGGTGGGAACTCGACCGAGACGCCGAAGAC CCTACGGAGACTGCCGAGGACAACTCGAGGAGGGTGGGGATGACGTCAAGTCATCATGCCCCTTATGTCCAGGGCTTCACACAT GCTACAAATGCTGGTACAATGCGATGCGACACGGGTGAAGAAAGCGAATCCAGAAAGTCCGTCTCAGTTCGGATCGAGGTCTGCA ACTCGACCTCGTGAAGCTGGAATCGCTAGTAATCGCGCATCAGCAACGGCGCGGTGAATACGTTCCCGGGCCTTGTA CACACCGCCGCCACCATTGAAAAGTAAGATGCTGAAGCGCCCAAAGGTAACTCATCATGAAGCATCAACCCCTTAAACATAGGTTCGAAAGTCGTGTACACCGTCCCGTCACGTCACGGATGAAGTCGGTAACACCCGAAGCCATGAGGGCGGCC AGTCGTAACAAGGTAGCGCTAGGGGAACCTGGCGGGGGGTGATCACCTCCTTCT |
| Bifidobacterium_dent ium_ATCC_27678_NCBI_ABIX02000000 2 | Bifidobacterium_d entium | ABIX02000002 | SEQ ID NO: 90 | TTTTCGTGAGAGGGTTCGATTCTGGCTCAGGATGAACGCTGGCGGCGTGCTTAACACATGCAAGTCGAACGGGATCCCG GGGTTCGTCCGGGTGAGTTGGCGAACGGGTGAGTAATGCGTGACCGACCTGCCCCATACACCGGAATAGCTCCT GGAAACGGGTGGTAATGCGGATGTCCGGTTCGATGCATGTCCTTCGGGAAAGGTTCCTTCCCATCGGTATGGGATGGGT CGCGCCTATCAGCTTGATGCGGGGTAAGCTCGCCTAGCGACTCGGAGATGCCGGCCTGAGATAGGGCGCGAACGCGGC CACATTGGGACTGAGATACGGCCCAGACTCCTACGGGAGGCAGCAGTGGGGAATATTGCACAATGGGCGCAAGCCTGATGA TGCAGCCATGCCGCGTGTATGAAGAAGGCCTTCGGGTTGTAAACTACTTTTGTGCAGAGAAGCAAGCGCCGGGGGTTGA GTGTACCTTGTACGGTACCTGCAGAAGAAGCGGCGGCTAACTACGTGCCAGCAGCCGCGGTAATACGTAGGGTGCAAGCGTTATCCGGAAT TATTGGGCGTAAAGCGCGCTAGGGCGGCTCTCTAAGCGTTGGATGTGAAAGCGGCTCTTGAAGCCGGACAGCTGCGGG TACCGCGAGGGCTAGGCCGGTTCAGGCTGGCGAAGCGGTGCCATTAAGAACTCGGAACGCAGGAAAAGCTAACCGCGCGA ACCCGTGAGAAGCTGGATGAATAAACTCAAAGGAATTGACGGGGGACCCGCACAAGCGGTGGAGCATGTGGCTTAATTGAAGCATCAACGCGGA TTAAGATACGGCCCAAGGCTAAAACTCAAAGGAATTGACGGGGTCCCGCACACACAAGCGGCGGAGCATGTGGCTTAATTGAAGCACCGCGGA |

FIG. 16AK

| | | | |
|---|---|---|---|
| Bifidobacterium_dentium_Bd1_NCBI_CP001750 | Bifidobacterium dentium | CP001750 | SEQ ID NO: 91 | GCATGCGGATTAATTCGATGCAACGCGAAGAACCTTACCTGGGCTTGACATGTTCCCGACGGCCGTAGAGATACGGCCT<br>CCCTTCGGGGCGGGTCGGGTTCACAGAGCGCAAGCCTGTTGTCAGTCGTCGTGTCGTGAGATGTTGGGTTAAGTCCCGCAACG<br>AGCGCAACCCTCGCCCTGTTGTTGCCAGCAACGGGCGGGTGGGAACTCACGGGGGTCACGGGGCCCGGGGTCAACTCGGAGGAA<br>GGTGGGGATGACGTCAGATCATCATGCCCCTTAAGTGCCCTTAAAACGTCCAAGGGCTACAACGCCGGGATG<br>CGACATGCGCACATGAGACGGGATCCAGCAGGCGATCAGCAACGCGCGAACGCGGCCTAACCCTTGTACACACCGCCCGTCAAGTCA<br>TGAAAGTGCGCTAGTAATCGCGGATCAGCATGCCGCGGTGAATACGTTCCCGGGCCTTGTACACACCGCCCGTCAAGTCA<br>TGAAAGTCGGTAACACCCGAAGCCGGTGGCCTAACCCTTGTGGAGGGAGCCGTCGAAGGTGAGGCTCGTGATTGG<br>GACTAAGTCGTAACAAGGTAGCCGTACCGGAAGGTGCGGCTGGATCACCTCCTTTCT |
| Bifidobacterium_dentium_JCVIHMP022_NCBI_AEHJ01000003 | Bifidobacterium dentium | AEHJ01000003 | SEQ ID NO: 92 | TTTTATGGAGGGTTCGATTCTGGCTCAGGATGAACGCTGGCGGCGTGCTTAACACATGCAAGTCGAACGGGATCCCGG<br>GGGTTCGCCTCCCGGGTGAGAGTGCCGGTAATGCGAGTGAGTAATGCGTGACCGACCGTGAGTAATGCGAGTCCTG<br>GAAACGGGTGGTAATGCCGGATGCTCCGGTTGGATGCATGTCCTTCCGGGAAAGATTCCATCGGTATGGATGGGT<br>GCGTCCTATCAGTTGATGGGGGGAGTAACGGCCCACCATGGCTTCGACGGTAGCCGGCCTGAGGAGGGCAGACGGC<br>ACATTGGGACTGAGATACGGCCCAGACTCCTACGGGAGGCAGCAGTGGGGAATATTGCACAATGGGCGCAAGCCTGAT<br>GCAGCGACGCCGCGTGCGGGATGACGGCCTTCGGGTTGTAAACGCTTTTGATCGGGAGCAAGCCCTTCGGGGTGAG<br>TGTACCCTTTCGAATAAGCACCGGCTAACTACGTGCCAGCAGCCGCGGTAATACGTAGGGTGCAAGCGTTATCCGGAATT<br>ATTGGGCGTAAAGGGCTCGTAGGCGGTCTGTCGCGTCTGCTGTGAAAGCCCGGGGCTTAACCGTGGGAAGTGCAGTTAGAGATCGGGAAGAA<br>CACCAATGGCGAAGGCAGGTCCTGGCGTACGGAAGACCGGAACAGGATTAGAT<br>ACCCTGGTAGTCCACGCCGTAAACGGTGGATGTGGGCCAAGGGTCAAACCTGGAGCGACCGCCGTAACGCAT<br>TAAGCATCCCGCCTGGGGAGTACGGCCGCAAGGTTAAACTCAAAGGAATTGACGGGGGCCCGCACAAGCGGCGGA<br>GCATGCGGATTAATTCGATGCAACGCGAAGAACCTTACCTGGGCTTGACATGTTCCCGACGGTCGTAGAGATATGGCCT<br>TCCCTTCGGGGACAGGGTAAACAGGTGGTGCATGGCTGTCGTCAGCTCGTGTCGTGAGATGTTGGGTTAAGTCCCGCAACG<br>AGCGCAACCCTCGCCCTGTGTGCCAGCATCATGGGTTGGGGACTCACGCAGGGACCGCCGGGGTCAACTCGGAGGAA<br>GGTGGGGATGACGTCAGATCATCATGCCCCTTACGTCCTGGGCTACACACGTGCTACAATGGCCGGTACAACGGGTTGCCAACCCCGTGAG<br>GGGGAGCTAATCCCATAAAGCCGGTCTCAGTTCGGATTGGAGTCTGCAACCTCGACTCCATGAAGTCGGAGTCGCTAGTAATCGCGATCAGC<br>AGCGCAACAATGGCGGATTGGAGGGCTTAACTACGTGCCAGCAGCCGCGGTAATACGTAGGGTGCAAGCGTTGTCCGGAATTATTGGGCGTAAAGGGCTCGTAGGCGGTCTGTCGCGTCTGCTGTGAAAGCCCGGGGCTTAACCGTGGGAAGTGCAGTTAGAGATCGGGAAGAACACCAATGGCGAAGGCAGGTCCTGGCGTACGGAAGACCGGAACAGGATTAGATACCCTGGTAGTCCACGCCGTAAACGGTGGATGCTGGATGTGGGGCCAAGGGTCAAACCTGGAGCGACCGCCGTAACGCATTAAGCATCCCGCCTGGGGAGTACGGCCGCAAGGTTAAACTCAAAGGAATTGACGGGGGCCCGCACAAGCGGCGGAGCATGCGGATTAATTCGATGCAACGCGAAGAACCTTACCTGGGCTTGACATGTTCCCGACGGTCGTAGAGATATGGCCTTCCCTTCGGGGACAGGGTAAACAGGTGGTGCATGGCTGTCGTCAGCTCGTGTCGTGAGATGTTGGGTTAAGTCCCGCAACGAGCGCAACCCTCGCCCTGTGTGCCAGCATCATGGGTTGGGGACTCACGCAGGGACCGCCGGGGTCAACTCGGAGGAAGGTGGGGATGACGTCAGATCATCATGCCCCTTACGTCCTGGGCTACACACGTGCTACAATGGCCGGTACAACGGGTTGCCAACCCCGTGAGGGGGAGCTAATCCCATAAAGCCGGTCTCAGTTCGGATTGGAGTCTGCAACCTCGACTCCATGAAGTCGGAGTCGCTAGTAATCGCGATCAGCAGCGCAACAATGGCGGATTGGAGGGCTTAACTACGTGCCAGCAGCCGCGGTAATACGTAGGGTGCAAGCGTTGTCCGGAATT |

(Note: The nucleotide sequences shown are partial OCR reconstructions of the dense text in the figure and may contain inaccuracies due to image resolution.)

FIG. 16AL

| | | SEQ ID NO: | |
|---|---|---|---|
| Bifidobacterium_denti ium_NCBI_M58735 | Bifidobacterium_d entium | M58735 | SEQ ID NO: 93 | TTTCGTGGGAGGGTTCGATTCTGGCTCAGGATGAACGCTGGCGGCGTGCTTAACACATGCAAGTCGAACGGGATCCCGG GGGTTCGCCTCGCGGNGAGAGTGAGTGCTTGCGGAAGACGACCTTCCCGGNAAAGGTTCCATGGGATGGGATGGNNT GGAAACGCGGTGTAATGCTCCGGTNATGCTGCNATGTCCCTGGATGCTAATGGGTGAGTAATGCGGNATAGCTCCT CGNGTCCTATCGGAGACTTGATGNGNGGNTAACCATGGCTTCGACGTGAGACTGGGGNATAACTGGCCGAACGGCG CACATTGGGACGACGNNNNNTGCGGNATGGAGGCCTTCGGGTTGTAAACCGNTTGATCGGAGCAAGCCNTTCGGGGTGA GTAGCCCTTCGAATAACACCGGCTAACTACGTGCCAGCAGCCGCGGTAATACGCGNGGNATGAGCAGAATCGGGAAT TATTGGGCGTAAAGGGCTCGTAGGCGGNNNTCGTCGNNTCGGTGAAATCCCATCGCTTAACGGTGNNCTGCGCCGG GTACCGGGCGGCTGGAGTGGNAGGTCTGGCGTAGGCGGNGNNACTGACGCTGAAGACTGAAATGTGTAGATATCGGGAAGAA CACCAATGCGGTAGTCCACGCGNATGCCGTAAACGGTGGATGCTGGAGGGNGTTCCACNGGTTCGTGTCGAGCTAACGCGTT AAGCATCCNGCCTGGGAGTACTTTCCGAAGCTAAAACTCAAAGAAATTGACGGGNNCCNGCACAAGGGCNGAGC ATGCGGATTAATTCGATNNAACGCGAAGAACCTTACCTGGCCTTGACATGTTCNGACACATGTTAGAGATACGNNMNCC TTCGGGACGNGNCACAGGTGGNGCATGGCTGTCGTCAGCTCGTGTCGTGAGATGTTGGGTTAAGTCCCGCAACGAGC GCAACCCTCGCCTGTGTGCCAGCATCATCATGCCCCTTAGCGTCACGCTAAATGGCCGGTACTGCCAACGGGATGCGA CATGCGGAATTATGGGGCGTAGATCCGGACAATGCCGTAAAGCCCGGATCAGTCAAGGCTAGTCCGAACCCGATCCATGACGAT GTCGCTAGTAATCGCGGATCAAGAATGCCGCGGTGAATACGTTCCCGGGCCTTGTACACACCGCNCGTCAAGNCATGA AAGTGGGNAGCACCCAGGTGACTTGGCACTTAAGCCCGGGGATGAGCCGTCTAAGGTGGATGTCGTGAGCGGGTAAGGTGA C |
| Bifidobacterium_galli cum_DSM_20093_N CBi_ABXB0300004 | Bifidobacterium_g allicum | ABXB03000004 | SEQ ID NO: 94 | TTTTGTGGAGGGTTCGATTCTGGCTCAGGATGAACGCTGGCGGCGTGCTTAACACATGCAAGTCGAACGGGATCCGG CCGAGCTTGTCTTGGCTGGTGGAGCGAAGCGGGCGAACGGTGAGTAATGCGTCGCTTGTGACCAACCTCGCCCTGTGTCC CCTGGAAACGCGGGTGGTAATGCCGGATGCTCCGCTCATCGCATGGTGGTGTGGGAAATGCTTTGCGCCATGGAGGGG GGTCGGCGTCGTCGCTCATCAGCTTGGCGGACTCGTCGCCATCCTGCGCGGTGTAGCGCGGTGTAGCCGCTGACC GGCCCACATTGGGCACTGAGATACGGCCCAGAGACTCTGGGCAGCAGCCAGTAGCGCGGAGCCGAGGAATATTGCACAATGGGCGCAAGC CTGATGCAGCGACGACGCGCGTGAGCCTTCGGGTTGTAAACCGCCGCGCCGCCGGCCCTCTGGGTGAAACTCGGTTGTACGG GGGATGTTGAGCTAGCTTGCGCAATAAGCACCGGCTAACTACGCCTGGCAGTGCCAGCCGCGGTAATAACGGTAGGTGGCAAGC GTTATCCGGAATTATTGGGCGTAACCCGGCGCCGCCAAGCGGCGTGTCCCGCAAGACTCGGAAGTCCGTAAGGGTC GATCTCGCCGGAAGAACACCAATAACCGGTAAGCATCCGGAAGGAAGCTTACCTGGGAGGCGGAAGTCCCGGTAGCA CAGGATTAGATACCGCTGGTTAAGCGCCGCAGAACGTTACCGGCGTGAAAAATCAAAGAATTGACGCGGCCCAC AAGCGGCGAGCATCTGGTGCATCTTGCGGTGCAAGGCGTGCATCATCCGTAGCGACAGATGTCCGATCGCCGGG AGATGCGGCCTGTTCCCTTCGGGACGAACGCCAACCGTCGCCCTGGTTGCCAGCTAGCGCAGGTGGTGCATGGCTGTTCGATCTCTGGGGGGTGGTGTTCGTGCAGACTGCCAAGGC GTCCCAACGAGCGGCCACCGTCGAGATACGACTGAGGGGCCTTCTCGGGCACTGACCGGAAGCGTCGTGAGGCCGACT ACACAGAGGGGTGCGGATGTCAAATCCTCATGCCCCTTACGTCAATGGTTGCGGTGATGGTGCTACCTCAAGGGT TGCCTGAAGCGCCGGAGTCGGCTGACTGACTGAACGCGACCGTCTCCGGGCTACTGAATACGCATTACACCACCGC CCGTCAAGTCATGGGGACTGCTAAGCGTAACAAGGTAGCCGTAAGGGTGAACAGGTCTCCCTTCTACGG |
| Bifidobacterium_infa ntis_KB_10_NCBI_A Y151398 | Bifidobacterium_inf antis | AY151398 | SEQ ID NO: 95 | GATTCTGCTCAGGATGAACGCTGGCGGCGTGCTTAACACATGCAAGCGAACGGGATCCATCAGGCTTTGCTTGGTG GTGAGAGTGGCGAACGGGTGAGTAATGCGTGACCGACCTGCCCCATACACCGGAATAGCTCCTGGAAACGGATGCTAA TGCCGGATGCTCCAGTTGATCGCATGGTCTTCTGGGAAAGCTTTGCGTCTATCAGCTTGGCGCGCTGGTCGACTCTTGCTGATGGGGTGCGC ACGGCCGGGTAACGGCCCACCGTGGCTTCGACGGTAGCCGGACCTGAGAGGGCGACCGGCCACATTGGGACTGAGAT ACGGCCCAGACTCCTACGGGAGGCAGCAGTGGGGATATTGCACAATGGGCGAAAGCCTGATGCAGCGACGCCGCGT GGGAGTGATGATGCCCTTCGGGTTGTAAACCGCTTTTATCGGGGAGCAAGCCTGTAAACGCGTTACCCGTATGAGAAACCCGA GGCTAACTACGTGCCAGCAGCCGCGGTAATACGTAGGGTGCAAGCGTTATCCGGAATTATTGGGCGTAAAGGGCTCGT AGGCGGTTCGTCGCGTCCGGTGTGAAAGTCCATCGCTTAACGGTGGATCCGCCACGGGTACGGGCGACTTGAGTGC |

FIG. 16AM

| | | | |
|---|---|---|---|
| Bifidobacterium_kashiwanohense_HM2_1_NCBI_AB491757 | Bifidobacterium_kashiwanohense | AB491757 | SEQ ID NO: 96 | GGTAGGGGAGACTGGAATTCCCGGTGTAGCGGTGGAATGCGTAGATATATGGAAGAACACCAATGGCGAAGGCAGGTC<br>TCTGGGCCGTTACTGACGCTGAGGAGCGAAAGCGTGGGGAGCGAACAGGATTAGATACCCTGGTAGTCCACGCCGTA<br>AACGGTGGATGCTGGATGTGGGGCCCGGTTCCGTGCCGGTTCCGTTAAGCCGTTAAGCATCCCGCCTGGGGA<br>GTACGGCCGCAAGAACCTTACCTGGGCTTGACATGTTCCCGACGGTCGTAGAGATATCACCTTTCCCTTCGGGGCGG<br>AACGCGAAGAACCTTACCTGGGCTTGACATGTTCCCGACGGTCGTAGAGATATCACCTTTCCCTTCGGGGCACA<br>GGTGGTGCATGGCTGTCGTCAGCTCGTGTCGTGAGATGTTGGGTTAAGTCCCGCAACGAGCGCAACCCTCGCCCGTG<br>TTGCCAGCGGATTATGCCGGGAATTGATGGGGTAACTCGCAAGAGACTGCCGGTGACAATCCGAGGAAGGTGGGGATGACGTCAAGTCATCATGCCCCTTATGACCAGGGCTTCACACGGTGCTACAATGGCCGGTACAACGGGATGCGAAGGCAAGCGGACC<br>GGAATCCCCTGAAACCGGTCGTAGTTCGGATTGGAGGGCTGAAACCTCGAAAGTCGTCATGCCCCTTATGACCTGCAGGTCGCTAGTCGCCCGGCCTTGTACAGACCGCCCGTCAAGTCACGAAAGTTGGGTAGCACCCG |
| Bifidobacterium_longum_B3_NCBI_JN02_0358 | Bifidobacterium_longum | JN020358 | SEQ ID NO: 97 | AGGGTTCGATTCTGGCTCAGGATGAACGCTGGCGGCGTGCTTAACACATGCAAGTCGAACGGGATCCCAGGAGCTTGC<br>TCCTGGGGTTAGTGAGCGAACGGGTGAGTAATGCGTGACCAACCTGCCCATGCCCCAGGACGGAATAGCTCCGGAAACGGG<br>TGGTAATACCGGATAGCTCCATCACATCGGGGATATAACCGTCTGGTGGTGGCCAGGGCCACATTGGGA<br>CTGAGATACCGGCCCAGACTCCTACGGGAGGCAGCAGTGGGGAATATTGCACAATGGGCGCAAGCCTGATGCAGCGAC<br>GCGCCGTGCGGGATGACGGCCTTCGGGTTGTAAACCGCTTTTATCGGGAGCAAGCGTTATCGGAGTGTACCTTTCG<br>AATAAGCACCGGCTAACTACGTGCCAGCAGCCGCGGTAATACGTAGGGTGCAAGCGTTATCCGGAATTATCGGGCGTAA<br>AGGGCTCGTAGGCGGTCGTGCGGTGTGTGTGAAATCCATCGCTTAACGGTGAAAGTGCCGCGGGGTGAAATCCATCGCTTAACGGTGCATGTGTGGAAGACAGAGTCCGGATTGTGGAAGACAGAGTCCGGATTGTGGGAAGACGGAGTGCGGTAGTA<br>CGCCGGTGCTCTGGGCCGTTACTGACGCTGAGGAGCGAAAGCGTGGGGAGCGAACAGGATTAGATACCCTGGTAGTCC<br>ACGCCGTAAACGGTGGATGCTGGATGTGGGGCCCGTCCGCGAGGGTAGAGATGACCCTTGGCATCCCGCCTAAGCATGCAGGATTGGGGAATGCGAAGATTGGAGGCCAAGCGCAACCCTCG<br>GTTCACAAGGTTGCAGCGCCGCGGTGAATGCGTTCCCGGAGATGTTGGGTTAAGTCCCGCAAGAGCGCAACCCTCG<br>CCCTGTGTTGCCAGCGACGCTCATGGTGCGAACGTCAACCTCGAGTCGAGCGCAACCCTCTAAGGTGAGCCGCGTAGTA<br>TCAGATCATCATGCCCCTTACGTCCAGGGCTACACACGTGCTACAATGGCCGGTACAACGGGATGCGAAGCGCGGGATGACCG<br>ATCGCGGATCAGCAACCGGAATCGCTAGTAAGCCGGAATCGCTAGTAAGGCGTGGGATGCGCGGGATGCGCGGGATGCGCGGGATGCGGGATGCGGGATGCGGGATGCGGGATGCAAGTCGCGGAATCAGGCACCGTGCGGGATGGCGGAATCAGCAACCGGAGAGTTCGGAATCAGCAACCGGAGAGTTCGGATGCAAGTCGCGGAATCGCGGAATCGCGGATGCGGGCGGTGGAATGGGCGGAATCGCGGATGCGGGGGATGCGGGATGCGGGGGATGCGGGATGCGGGGGGCGGGGGGGGGG |

FIG. 16AN

| | | | |
|---|---|---|---|
| Bifidobacterium_long um_BG_CBT3_NCBi _HQ591347 | Bifidobacterium_lo ngum | HQ591347 | SEQ ID NO: 98 | GATGAACGCTGGCGGCGTGCTTAACACATGCAAGTCGAACGGGTGAAGCAGTGGCGAACGGGTGAGTAATGCGTGACCGACCTGCC CCATACACCGGAATAGCTCCTGGAAATAGTGGCGGAGCGGTGGAATGGCGGACCGTCGGTGGTCCTA TCAGCTTGACGGCGGGATAACTGCCCGAAACTGGGGATAACACCGGATACCGCATGATAAGCCGGACCGCATTGGG ACTGAGATACGGCCCAGACTCCTACGGAGGCAGCAGTGGGAATATTGCACAATGGGCGCAGCTGATGAGCAGAGCG GCGCGTGAGGGATGACGGCCTTCGGGTTGTAAACCTCTTTTATCGGGGAGCAAGCGAGAGTGAGTTTACCCGGTTTGAATAAGGGCTCGTA GCTAACTACGTGCCAGCAGCCGCGGTAATACGTAGGGTGCAAGCGTTATCCGGAATTATTGGGCGTAACGGGCTCTCAGGTCG GTAGGCGGAGCATTAGGTCTGTGGTGAAAGATAATCGGCTCCTAACCGAGCGCAGTGCCAGATGCAGCAGTCT CTGGGCCGACTGAGGCTGAAGGGCCCACCTGCGGTTACTGAGTACCGGCAAGCCGAAGGCCAGGGCTTAACTGGG CTAAACTCAAAGAAATTGACGGGGGCCCGCACAAGCGGCGGAGCATGCGGATTAATTCGATGCAACGCGAAGAACC TTACCTGGTCTTGACATGCACAGGTCGCTCGCTAGAGATGGATGTTTGGGGAAGCACCGGAGAAGGTG AGAGCAACGCTGCGCCCATGTTGTCAGCTCGTGTCGTGAGAACCGAAGACCCCGACGTCGTTAAGAAGGGG GGGATGACGTCAATCATCATCATGCCCCTTACGTGAGGGGCCTTACACACGTGCTACACCATGGCCGGTACAAGGGGGGC GGACGCGCGGAATCAGCAACGCCGCGGCCCAATCAGCGAAGCGCGCGGGGCCGTCAAGCCCCATCAGCGAGATCGTA AATCGCGCTTAAGCCAGCAGCCCGGCAACTCAAAGAAATTGCACAACTGCAACGTGGCGAATCTTAACCTCGAAG GCGGGAGCATGACTGCCAGCAATCGGGATAATAATCGCGCGTATCCGGATTCGACTCGCTAGGAGGGCCCCGAAGG TCGTCAGCTCGTGTCGTGAGATGTTGGGTTAAGTCCCGCAACGAGCGCAACCCTTATCATGCCCCATCACCGCAAGGC AACTCACGGGGTACCACCGCTTGAAGATACCGACTCTTGCTGACCTGCAAGTCTGCTGGCCGCTACACG GACGCGCTTAAGCATCCCGCGTAACCGCCAACGGCGAAGAGGCCCAAGTCCGGGTAGTATATCGCAAGAATCATCGG CGGGCTACCATAGCAGTGGGGATTTCTACCAAGATCGCCGCCATGCCCCTTAAAAACCTTACCTGGGGCTTGCACACGGCACCGC AACTCACGGGGATACAAACACACCGCCCGTCAAGTCATGAAAGTGGGCAACCACGCGTCTA CGGGAAGTGC | | | | |
| Bifidobacterium_long um_CBT_6_NCBI_H Q591348 | Bifidobacterium_lo ngum | HQ591348 | SEQ ID NO: 99 | CGAACGAGTGGCGAACGGGTGAGTAATGCGTGACCGACCTGCCCCATACACCGGAATAGCTCCTGGAAACGGGTGGTA ATGCCGGATGCTGAAGCAGTGGCGCTTTGACGGCGTAGCGGGTGAGGCGACCGCATTAAGAGACCCACGGGTAGC CAGTCGGGAATATTGCACAATGGGCGGAAGCTGATGAGCAGGTACCGCGTGAGGGATGACGGCCTTCGGGTTGTAAA CCTCTTTTATCGGGGAGCAAGCGAGAGTGAGTTTACCCGTTTGAATAAGGACCGGCTAACTACGTGCCACGGTAATACG TAGGTGCAAGCGTTATCCGGAATTATTGGGCGTAACGGGCTCTCAGGTGGTCAAGTCATCG CTTAACGGTGAATATCCGCGCCGAAGAACACCGGATAGACCCTTCGGGCCCGAAGCAGTTCTGAGTTGCGGAACCGAAAGCGTGG GGGAGCAACAGGATTAGATACCCTGGTAGTCCCACGCCGTAAACGGTGGGCGCTAGGTGTGGGCGCCCGCAAGG CTAACGCGTTAAGCATCCCGCCGTGTGAGGAGCGGGGCACCTATGCGGCAATCGAACCTAAAACTCAAAGAAATTGCACGCGGG AACCCGAAGATCTTAGACGGTGGTTGATTGACTCTCGAAGAAGAAGCCCGTGCAACAGGCCGCCGTGACAGGTCCGGGT CCGGAAGTGTCCGCTCGTGTCGTGAGATGTTGGGTTAAGTCCCGCAACGAGCGCAACCCTCGCCCCGTGTTGCCAGCAGGGCCGGG AACTCACGGGATAACTGTCCAACATCGTGAGATGAATCCGAACGTCAGCACCACCGCCGTAAGGTGCATGGCTGGTCG GCCGGCTTAAGCATCTCAACTCGACTGCCGGTGACAATCCGGGAGGAAGGCGAGGATCGCAAGGATCATCATGCCCCTTATG TCCTGGCCTCGCACACGCGTGCTACAATGGCCGGTACAACGGGATCCGCAAGGTGCCGTGATGGAGTGACCGCAAGG CGGGGCCTGGCGGAACAGCTGGCCAGCAGCATCATGCTCGACCAGCATCGCGCCCAGCATCCTGCGTGACTGGAACGCCATGG CAAAAGGACAGTTTCAGGCTGCAAACTCGCCTACATCAAACCGGAATCGTAGAATCGTAGGAACCGTGAAGGTCGCAGTGGCAT GTGG | | | | |
| Bifidobacterium_long um_DJ010A_NC_01 0816_NCBI_CP0006 05 | Bifidobacterium_lo ngum | CP000605 | SEQ ID NO: 100 | TGTGGAGGGTTCGATTCTGGCTCAGGATGAACGCTGGCGGCGTGCTTAACACATGCAAGTCGAACGGGATCCATCAGG CTTTGCTTGGTGGTGAGAGTGGCGAACGGGTGAGTAATGCGTGACCGACCTGCCCCATACACCGGAATAGCTCCTGGA AACGGGTGGTAATGCCGGATGCTCTCAGTGGTCATCTCTGGAAACGCTTTCGCGGATATGGATGGGGTCGCG TCCTATCGCGTAGATACGGGCCACCGCTCAGACTCCTACGGGAGGCAGCAGTGGGGAATATGCACAATGGGCGACACA TGGGACTGGAGACGCGTGAGGAGCATGCCGAGCAGTGACGCGTTAAACCTCTTTATCGGGGAGCAAGCCAAGTGAGTTTATCCGGTA GCGACGCGGTCAATCGCGTCAGTAACGTCATGCCGGTGAGCGCATCCTGTAATGCCGGATGCTGAGACAGTCGCTCAT TGAATAAGCACCGGCTAACTACGTGCCAGCAGCCGCGGTAATACGTAGGGCGCAAGCGTTATCCGGATTTATTGGGCGTAACG GGCTTCGTGGGGCTCCGCAGCACCCAAATCCTGGTTGATCGCCTTCTTAAAACACCTGAGACCTCGCAGCGGTAGAGCTCCGGCAA GTCCACGCCGTAAACGGTGGGACACTAGGTGGAGCTCAGCCTGACGAATGGGATTGGAGAGAACAGGATTAGATACCCTGGTA GCTCCCACGCCGTAAACGTGGGGGCCCGCGGGCCGTACGAGGCTCGTGTCGTGAGAAATGGCTTAAGCGCCGATCATGTCGAGGACGAAG CGAAGGTTCGCTGCAAACTCGCCTACATCAAACCCGGAATGTTGTAGGATATGGAACAGGATTAGATACCCTTGGTCGTAGGGATTTGAGTGCGAAGGATGTCCCCGAGTAATGCGTCGGAA TTAATTCGATGGAACGCGAAGAACCTTACCTGGGCTTGACATGTTGTCGGTGGAGATGTGAGAGATGTCCGAAGTCTGCAA GCGGTTCACAGGTGGTGCATGGCTGTCGTCAGCTCGTGTCGTGAGATGTTGGGTTAAGTCCCGCAACGAGCGCAACCC | | | | |

FIG. 16AO

| | | | |
|---|---|---|---|
| Bifidobacterium_long um_H3_NCBI_JN02 0355 | Bifidobacterium_lo ngum | JN020355 | CTCGGCCCGTGTTGCCAGCGGATTATGCCGGGGAACCGCCGCGGGGTTAACTCGGAGGAAGGTGGGGAT GACGTCAGATCATCATCGTGAGATGACGAGGGGGTAACCCCACGGTTGCTTCGGGGGGTAGCGGCGGGAG GAGCGGAGCGGACCTTACGTGAGTGATGACGGCCTTCGGGATCGCAGTCGCAGTAGTGATTATCGCACAATGC GAGCAAGCCTGATGCAGGGAACCTGAAAACCTGGTTGCAACTCGTGAAGGCGAAGGCGGCT AGTAATCGCGAATCAGCAACGCCGCGGTGAATACGTTCCCGGGCCTTGTACACACCGCCCGTCAAGTCATGAAAGTGG GCAGCACCCGAAGCCGGTAGCGCCGAAGGTGCGGCGAAGGTGCTGAAGTGAGCCGTCGTGATTGGGACTAAGTCG TAACAAGGTAGCCGTACCCCGAAGGTGCGGCTGGATCACCTCCTTCT (SEQ ID NO: 101) |
| Bifidobacterium_long um_JDM301_NCBI_ CP002010 | Bifidobacterium_lo ngum | CP002010 | ATGGGATTGGGTTCCTTCTATCGAGATGACGGGGGGTAACCCCCACGGTTGCTTCGGGGGTAGCGGCGGGAGAG AGGGAGCGGCCCTCATTGTGAGTGACGAGGGCGGCCTAGGAGATTGATCGCACAATGCAGGGGAGCAGGCCCAC AAGCAAGCCTGATGCAGGGAACTGAGAGGCCCGTGAGGAATTGAGAGGCCTACTGAACCTGGGTTAACTC CGGGAATTATTGGGCGTAAAGGGCTCGTAGGCGGTTCGTCGCGTCCGGTGTGAAAGTCCATCGCTTAACGGTGATCC CGGGGGGGTACGGGCAAGACTGAGTGAAAATAGAGGCGAAATAGGAGCAACAGG GGAAGAACACCAATGGCGAAGGCAGTCTGCCGGCGGCTCTTGCGTAGATCGCTGGATCGCAGAGAAACAAGG ATTAGATACCCGTGAGCATCCATGCCGTAACGATGAAATACTCGGACTGTAATACTCACCATGCACGGATCGCAGAGACTGAGAT AGGCAGCATGCGGATTAATTAGATACGGGGGGGCTTCCACAAGGGCTTGACATGTTCGACGATGGAGATCC GGAATCCGGGGCAAGCCCGGCGAGGCTCAGGAACCTGGGTTAATCGAGGCCTTCCCACGGGCTTAACTCCG CAGGAAGGCCAGGCTCAGCCGGTAAGCTCACCTGATCGAAGAGAGCGCGCGCTGCGATCGCGAATGCAGTATGTCACTCGTGCAGGGAGGAGCGTCAACTGAACAAGGTAGCTCAGCC (SEQ ID NO: 102) |
| Bifidobacterium_long um_R0175_NCBI_H M009032 | Bifidobacterium_lo ngum | HM009032 | AGTCGCAGGAACCCTGCCCCATGTTGATCCTGACCGAAGCTCTCCTCTGGTCGCATGATCCCATA CACCGGAATAGCTCCTGGAAACGGGTGGTAAATGCGGATAATCCTCCAGGGCCCACCGTGGCTTCCACGTGCCG GTATGGATGGCGTCGCGTCATCAGCTTGACGGGGGACTCCATAGAAGCGCCGGACAGCCCCGCGAGATTGCAAGT AGAGGGGCGAACGCGGCCCACATTGGGACTCCAGAGATACGGCCGACAGCTGAGCGATAATGGCGAGC GGGGACCGAAGTGAGTTTATCCCGTTCGGGGTTGCATGGCCAGGCGGCGACCTAACTACGGTCAAGCCAATAT GCGGAGCCAGAGTGAGCTGCCCCGTGTATAACGTAGGTGCAAGGTCAAGCG (SEQ ID NO: 103) |

FIG. 16AP

| | | | |
|---|---|---|---|
| Bifidobacterium_long um_SB11_NCBI_AY 850359 | Bifidobacterium_lo ngum | SEQ ID NO: 104 | TTATCCGGGAATTATTGGGCGTAAAGGGCTCGTAGGCGGTTCGTCGCGTCCGGTGTGAAAGTCCATCGCTTAACGGTGGA TCCGGCGCCGGGTACGGGCGGGCTTGAGTGCGTAGAGGCGAGTGGAATTCCCGGTGTAGCGGTGAAATGCGTAGATA TCGGGAAGAACACCAATGGCGAAGGCAGCTCGCTGGGCCGTTACTGACGCTGAGGAGCGAAAGCGTGGGGAGCGAAC AGGATTAGATACCCTGGTAGTCCACGCCGTAAACGGTGGATGCTGGATGTGGGGCCCGTTCCACGGGTTCCGTGTCGG AGCTAACGCGTTAAGCATCCCGCCTGGGGAGTACGGCCGCAAGGCTAAAACTCAAAGGAATTGACGGGGGCCCGCACA AGCGGCGGAGCATGCGGATTAATTCGATGCAACGCGAAGAACCTTACCTGGGCTTGACATGTTCCCGACGGTCGTAGA GATACGAGGCTTCCCTTCGGGGCGGGTTCACAGGTGGTGCATGGTCGTCGTCAGCTCGTGTCGTGAGATGTTGGGTTAAG TCCCGCAACGAGCGCAACCCTCGCCCGGTGTTGCCAGCATCAGTTGGGCACTCTCCGGGGACTGCCGGTGACAAACCG GAAGAAGGTGGGGATGACGTCAAGTCATCATGCCCCTTATGTCCAGGGCTTCACGCATGCTACAATGGCCGGTA CAACGGGATGCGACAGTGCGAACTCGAGCTAATCAGCGAACGTCGCGGTGAATCGCCCGGGCCTTCCCGGGCCTTGTAACACACGGCC CGTCAAGAG | AGAGTTTGATCCTGGCTCAGGATGAACGCTGGCGGCGTGCTTAACACATGCAAGTCGAACGGGATCCATCAGGCTTTGC TTGGTGGCGAGTGGCGAACGGGTGAGTAATGCGTGACCGACCTGCCCATACACCGGAATAGCTCCTGGAAACGGGT TGGTAATGCCGGATGCTCCAGTGCATCGCATGGTGGTCTTCGGACCACGTCTCGGACACGGACGGAACGGACGG AGCTTGACGGCGGCGGTAAGACTCCTACGGGAGGCAGCAGTGGCGGAATATGCACAATGGGCGCAAGCCTGATGCAGCGAC GCCGCGTGAGGGATGACGGCCTTCGGGTTGTAAACCTCTTTTATCGGGGAACACGATTAGGAGTGTAAAGAGCTTGAA TAAGCACCGGCTAACTACGTGCCAGCAGCCGCGGTAATACGTAGGGTGCAAGCGTTATCCGGAATTATTGGGCGTAAAG GCCTCGTAGGCGGTTCGTCGCGCTCCGGTGTGAAAGTCCATCGCTTAACGGTGGATCTGCGAGGAGAACGGAAGGCT GCAGTGCTCTCGGCGGGCCGTTACTGACGGCCGAAACGGAAGGCTAAAAGCAAAGGGGCCGAACGGGCGACGG GCCGTAAACGTTGGATGGTAGATGGACGCCTTCCCGTCCACGCCAGCGGGCACTACAGCGAAAGCGTTAAGCATCCCGCCT GGGAGTACGGCCGCAAGGCTAAAACTCAAAGGAATTGACGGGGGCCCGCACAAGCGGCGGAGCATGCGGATTAATTC GATGCAACGCGAAGAACCTTACCTGGGCTTGACATGTTCTCGAGATGTTCAGCAGAGATGCGAGCCGGGGGCT TCACAGGTGGTGCATGGTCGTCGTCAGCTCGTGTCGTGAGATGTTGGGTTAAGTCCCGCAACGAGCGCAACCCTCGCC GCCGTTGCCATCATGCAGTTGGGCAGCGGCCGCGGCACGAGCCGCAGGGCACAACGACGCGCAAGGTCGACGTC GGGAGAGTACGGCCGCAAGGCTGAAACGCGAGAATGCACTCAAGGTGTTCTCAGGGACTACCGCTCAGAGCGACCGC GGGAGTACGCTTAAGCTGGGAAAACTCAAGGCCTGCTCAGAGAATGCGCGCCGTAACGTCGACGCTCAAGATGCCTTTCCCG AGGAGTACCGTCAAGATCATGCCGCCGGGAGCGAAGGCTGCAACTGCCAAACCTACACACCGCCCGTCACACC GAGCGGATCAGCAACGCCGGTAACCCCGTGTGGGATGGAGCCGTCGAAGGCGGACTGCCTAACAACT GGGTAGCGCGAAGAGTCGGCCTGGATCACCTCCTT |
| Bifidobacterium_long um_subsp_infantis_ 157F_NCBi_AP0108 90 | Bifidobacterium_lo ngum | SEQ ID NO: 105 | TTTTTGTGAGAGGTTCGATTCTGGCTCAGGATGAACGCTGGCGGCGTGCTTAACACATGCAAGTCGAACGGGATCATC AGGCTTTGCTTGGTGGTGAGAGTGGCGAACGGGTGAGTAATGCGTGACCGACCTGCCCATACACCGGAATAGCTCCT GGAAACGGGTGGTAATGCCGGATGCTCCAGTTGATCGCATGGTTCTCGGGAAAAGTTTCCGGTATGGATGGGGTC GCCTCATCAGCTTGACGGACGGATAAAGCACGGAGCCCGGAGTGAGCTGCGTGCCACGGACGCGCGAAGCGGTC ACATTGGGACTGAGATACGGCCCAGAATTCCTACGGGAGGCAGCAGTGGGGAATATTGCACAATGGGCGAAAGCCTGAT GCAGCGACGCCGCGTGAGGGATGACGGCCTTCGGGTTGTAAACCTCTTTTATCTGGGAGCAAGCGAGAGTGAGTTTAC CCGTTGAATAAGCACCGGCTAACTACGTGCCAGCAGCCGCGGTAATACGTAGGGTGCAAGCGTTATCCGGAATTATTGG GCGTAAAGGGCTCGTAGGCGGTTCGTCGCGTCCGGTGTGAAAGTCCATCGCTTAACGGTGGATCCGCGCCGGGTACG TGGCGGGCTTGAGTGCGGTAGGGGAGACTGGAATTCCCGGTGTAGCGGTGAAATGCGTAGAGATCGGGAAGAACACCCTG TGGTCCACGCCGTAAACGGTGGATGCTGGATGTGGGGCCCGTTCCACGGGTTCCGTGTCGGAGCTAACGCGTTAAGC ATCCCGCCTGGGGAGTACGGCCGCAAGGCTAAAACTCAAAGAAATTGACGGGGGCCCGCACAAGCGGCGGAGCATGC GGATTAATTCGATGCAACGCGAAGAACCTTACCTGGGCTTGACATGTTCCCGACGGTCGTAGAGATACGAGGCCTTCCC TTCGGGGCGGGTTCACAGGTGGTGCATGGTCGTCGTCAGCTCGTGTCGTGAGATGTTGGGTTAAGTCCCGCAACGAGC GATGACGTCAGATCATCATGCCCCTTACGTCGTGGGCTACACACGTGCTACAATGGCCGGTACAACGGGATGCGACGC |

FIG. 16AQ

| | | | | |
|---|---|---|---|---|
| | | | | GGCGACGCGGAGCGGATCCCTGAAAACCGGTCTCAGTTCGGATCGCAGTCTGCAACTCGACTGCGTGAAGGCGGAGTCGCTAGTAATCGCGAATCAGCAACGTCGCGGTGAATGCGTTCCCGGGCCTTGTACACACCGCCCGTCAAGTCATGAAAGTGGGCAGCACCCGAAGCCGGTGGCCTAACCCCTTGTGGGATGGAGCCGTCTAAGGTGAGGCTCGTGATTGGGACTAAGTCGTAACAAGGTAGCCGTACCGGAAGGTGCGGCTGGATCACCTCCTTTCT |
| Bifidobacterium_longum_subsp_infantis_ATCC_15697_JCM_1222_NCBI_AP010889 | Bifidobacterium_longum | AP010889 | SEQ ID NO: 106 | TTTTTGTGGAGGGTTCGATTCTGGCTCAGGATGAACGCTGGCGGCGTGCTTAACACATGCAAGTCGAACGGGATCCATCGGGCTTTGCTTGGTGGTGAGAGTGGCGAACGGGTGAGTAATGCGTGACCGACCTGCCCCATACACCGGAATAGCTCCTGGAAACGGGTGGTAATGCCGGATGTTCCAGTTGATCGCATGGTCTTCTGGGAAAGCTTTCGCGGTATGGGATGGGGTCGCGTCCTATCAGCTTGACGGCGGGGTAACGGCCCACCGTGGCTTCGACGGGTAGCCGGCCTGAGAGGGCGACCGGCCACATTGGGACTGAGATACGGCCCAGACTCCTACGGGAGGCAGCAGTGGGGAATATTGCACAATGGGCGCAAGCCTGATGCAGCGACGCCGCGTGAGGGATGGAGGCCTTCGGGTTGTAAACCTCTTTTATCGGGGAGCAAGCGTGAGTGAGTTTACCCGTTGAATAAGCACCGGCTAACTACGTGCCAGCAGCCGCGGTAATACGTAGGGTGCAAGCGTTATCCGGAATTATTGGGCGTAAAGGGCTCGTAGGCGGTTCGTCGCGTCCGGTGTGAAAGTCCATCGCTTAACGGTGGATCCGCGCCGGGTACGGGCGGGCTTGAGTGCGGTAGGGGAGACTGGAATTCCCGGTGTAACGGTGGAATGTGTAGATATCGGGAAGAACACCAATGGCGAAGGCAGGTCTCTGGGCCGTTACTGACGCTGAGGAGCGAAAGCGTGGGGAGCGAACAGGATTAGATACCCTGGTAGTCCACGCCGTAAACGGTGGATGCTGGATGTGGGGCCCGTTCCACGGGTTCCGTGTCGGAGCTAACGCGTTAAGCATCCCGCCTGGGGAGTACGGCCGCAAGGCTAAAACTCAAAGAAATTGACGGGGGCCCGCACAAGCGGCGGAGCATGCGGATTAATTCGATGCAACGCGAAGAACCTTACCTGGGCTTGACATGTTCCCGACGATCCCAGAGATGGGGTTTCCCTTCGGGGCGGGTTCACAGGTGGTGCATGGTCGTCGTCAGCTCGTGTCGTGAGATGTTGGGTTAAGTCCCGCAACGAGCGCAACCCTCGCCCCGTGTTGCCAGCGGATTGTGCCGGGAACTCACGGGGGACCGCCGGGGTTAACTCGGAGGAAGGTGGGGATGACGTCAGATCATCATGCCCCTTACGTCCAGGGCTTCACGCATGCTACAATGGCCGGTACAACGGGATGCGACGCGGCGACGCGGAGCGGATCCCTGAAAACCGGTCTCAGTTCGGATCGCAGTCTGCAACTCGACTGCGTGAAGGCGGAGTCGCTAGTAATCGCGAATCAGCAACGTCGCGGTGAATGCGTTCCCGGGCCTTGTACACACCGCCCGTCAAGTCATGAAAGTGGGCAGCACCCGAAGCCGGTGGCCTAACCCCTTGTGGGATGGAGCCGTCTAAGGTGAGGCTCGTGATTGGGACTAAGTCGTAACAAGGTAGCCGTACCGGAAGGTGCGGCTGGATCACCTCCTTTCT |
| Bifidobacterium_longum_subsp_infantis_CCUG_52486_NCBI_ABQQ01000041 | Bifidobacterium_longum | ABQQ01000041 | SEQ ID NO: 107 | TTTTTGTGGAGGGTTCGATTCTGGCTCAGGATGAACGCTGGCGGCGTGCTTAACACATGCAAGTCGAACGGGATCCATCAGGCTTTGCTTGGTGGTGAGAGTGGCGAACGGGTGAGTAATGCGTGACCGACCTGCCCCATACACCGGAATAGCTCCTGGAAACGGGTGGTAATGCCGGATGCTCCAGTTGATCGCATGGTCTTCTGGGAAAGCTTTCGCGGTATGGGATGGGGTCGCGTCCTATCAGCTTGACGGCGGGGTAACGGCCCACCGTGGCTTCGACGGGTAGCCGGCCTGAGAGGGCGACCGGCCACATTGGGACTGAGATACGGCCCAGACTCCTACGGGAGGCAGCAGTGGGGAATATTGCACAATGGGCGCAAGCCTGATGCAGCGACGCCGCGTGAGGGATGGAGGCCTTCGGGTTGTAAACCTCTTTTATCGGGGAGCAAGCGAGAGTGAGTTTACCCGTTGAATAAGCACCGGCTAACTACGTGCCAGCAGCCGCGGTAATACGTAGGGTGCAAGCGTTATCCGGAATTATTGGGCGTAAAGGGCTCGTAGGCGGTTCGTCGCGTCCGGTGTGAAAGTCCATCGCTTAACGGTGGATCCGCGCCGGGTACGGGCGGGCTTGAGTGCGGTAGGGGAGACTGGAATTCCCGGTGTAACGGTGGAATGTGTAGATATCGGGAAGAACACCAATGGCGAAGGCAGGTCTCTGGGCCGTTACTGACGCTGAGGAGCGAAAGCGTGGGGAGCGAACAGGATTAGATACCCTGGTAGTCCACGCCGTAAACGGTGGATGCTGGATGTGGGGCCCGTTCCACGGGTTCCGTGTCGGAGCTAACGCGTTAAGCATCCCGCCTGGGGAGTACGGCCGCAAGGCTAAAACTCAAAGAAATTGACGGGGGCCCGCACAAGCGGCGGAGCATGCGGATTAATTCGATGCAACGCGAAGAACCTTACCTGGGCTTGACATGTTCCCGACGGTCGTAGAGATACGGCTTCCCTTCGGGGCGGGTTCACAGGTGGTGCATGGTCGTCGTCAGCTCGTGTCGTGAGATGTTGGGTTAAGTCCCGCAACGAGCGCAACCCTCGCCCCGTGTTGCCAGCGGATTATGCCGGGAACTCACGGGGGACCGCCGGGGTTAACTCGGAGGAAGGTGGGGATGACGTCAGATCATCATGCCCCTTACGTCCAGGGCTTCACGCATGCTACAATGGCCGGTACAACGGGATGCGACGCGGCGACGCGGAGCGGATCCCTGAAAACCGGTCTCAGTTCGGATCGCAGTCTGCAACTCGACTGCGTGAAGGCGGAGTCGCTAGTAATCGCGAATCAGCAACGTCGCGGTGAATGCGTTCCCGGGCCTTGTACACACCGCCCGTCAAGTCATGAAAGTGGGCAGCACCCGAAGCCGGTGGCCTAACCCCTTGTGGGATGGAGCCGTCTAAGGTGAGGCTCGTGATTGGGACTAAGTCGTAACAAGGTAGCCGTACCGGAAGGTGCGGCTGGATCACCTCCTTTCTACGGAG |
| Bifidobacterium_longum_subsp_infantis_LCR8_NCBI_HQ259743 | Bifidobacterium_longum | HQ259743 | SEQ ID NO: 108 | TTGCTTGGTGGTGAGAGTGGCGAACGGGTGAGTAATGCGTGACCGACCTGCCCCATACACCGGAATAGCTCCTGGAAACGGGTGGTAATGCCGGATGTTCCAGTTGATCGCATGGTCTTCTGGGAAAGCTTTCGCGGTATGGGATGGGGTCGCGTCCTATCAGCTTGACGGCGGGGTAACGGCCCACCGTGGCTTCGACGGGTAGCCGGCCTGAGAGGGCGACCGGCCACATTGGGACTGAGATACGGCCCAGACTCCTACGGGAGGCAGCAGTGGGGAATATTGCACAATGGGCGCAAGCCTGATGCAG |

FIG. 16AR

| | | | |
|---|---|---|---|
| Bifidobacterium_long um_subsp_longum_ATCC_55813_NCBI_ACHI01000139 | Bifidobacterium_lo ngum | ACHI01000139 | SEQ ID NO: 109 | CGACGCCGCGTGAGGGATGGAGGCCTTCGGGTTGTAAACCTCTTTTATCGGGGAGCAAGCGWGAGTGAGTTTACCCGT TGAATAAGGCTCGTAGGCGGTTCGTCGCGTCCGGTGTGAAAGTCCATCGCTTAAATAGTGGGGCGGCAATATCGGCG AAAGGCGCTCGTAGGCGGTTCGTCGCGTCCGGTGTGAAAGTCCATCGCTTAACGTGGATCCGCGGGTACGGGCG GGCTTGAGTGCCGGTAGGGGAGACTCTAGGGCGTAAAGCGCTCGTAGGCGGTTCGTCGCGTCCGGTGTGAAAGCGGCG GAAGGCAGAGTCTCTGGGCCGTCTACTGACGCTGAGGAGCGAAAGCGTGGGGAGCGAACAGGATTAGATACCCTGGT CCCAGCCGTAAACGGTGGATGCTGGATGTGGGGCCCGTTCCACGGGTTCCGTGTCGGAGCGAAACGCGGGAGCGATT AATTCGATGCAACGCGAAGAACCTTACCTGGGCTTGACATGTCGTCGTGTCCYAGAGATRTCSYAGGGGYTTCCTTCGGGGC GGGTTCACAGGTGGTGCATGGCTGTCGTCAGCTCGTGTCGTGAGATGTTGGGTTAAGTCCCGCAACGAGCGCAACCCT CGTCAGATCATCATGCCCCCCTTACGTGCCGGGAACTTGCGAGACTGCTGGAACGGGACGCCGGCGCCGAAGGT GGGCATGACGTCAAGTCATCATCGACCCCGTACAATGCCGCCGGAGCGATGGCCGGTACAAGGACGGGGCCGA CGGAGCGCAACGGTAACCGGTGAATCCGCGGTGAATGCAACGGGCCCGCAATCATCGAGCGAGATCGGTGTAACGAA TAATCGCAATCGCACAACGCCGTGAATACGTTCCCGGGCCTTGTACACCCGGCCCGTCACGCATGCCAACGATGCTGGAT AGCACCGGAAGTCCGCCCTTGACTGGAGCGCTGGATTGGAACCGGAAGTCCCGCCCTGACAACCCGCTAAGCGAATGCCGA |
| Bifidobacterium_long um_subsp_longum_DSM_20219_NCBI_AP010888 | Bifidobacterium_lo ngum | AP010888 | SEQ ID NO: 110 | TTTTGTGGAGGGTTCGATTCGATTTGGCTCGGATGAACGCTGGCGGCGTGCTTAACACATGCAAGTCGAACGGGATCCATC AAGCTTGCTTGGTGGTGAGAGTGGCGAACGGCTGAGTAAGTGCGTGACCGACCTGCCCATAACCGGAATAGCTCCT GAAACGGATGGTAATGCCGGATGCTCCAGTTGATCGCATGGTCTCGAAAGCTTTGCGGTATGGGATGGGTC GCGTCCTATCGCCCGATGAAGATGGCGCATGGCAGTGAGGCCCAAGCCGCCAGATGGCCACAGGGTTTTTATCGGGGAGGAAGC CATTGGGACTGAGATACGGCCCAGACTCCTACGGGAGCAGTGAAGCAAGCCAAGTAATTGCACAATGGGCGCGAAGCCTGATG CAGCGACGCCGCGTGAGGGATGAAGCTACGGCCTAGGGTTCGTCGCAGGCAGTGAAGCGTGAAGTAGGGTAGGGCAAGGGTTATCC CGTTAAAGGAGAGCGTAGGCGGTACGGCGATGTCATGGTGTCGTCAGCTCGTGTCGTGAGATGTTGGGTTAAGTCCCGCAACGAGCGCA GCGGGTTGAGTGCGTAGGGCTAGACCCCCAAGAACTCAATGGCTGCAACGGATAAGATATGCCGGACAAGCG GCGAAGGCAGGTCTCTGGGCCGTAAACGGTGGTGCATGGCTGTCGTCAGCTCGTGTCGTGAGATGTTGGGTTAAGTCCCGCAACGAGCGCA TAGTCCACGCCGTAACCGGGGGAACTTTCGTCGGGATGCCCTGGAGGGTATCGGGAGTATCAACCGGTGGCAAGACACCCAAT TCCAGCGGGGCGCCGGGTAACGGCCCAAGCCCCAAGAAGCTTCTGACGATGTTCCGGGGATGTTTGCTCACGAGCTAAAGCTGGAAGTGCGGGCAA GATTAATTCGATGCAACGCGAAGAACCTTACCTGGTCGTTGACATGTTGTCAGTGCTAAAGACCATGGGGTGCC GCGGGCGGTTTCCAGGTGGTGCATGGCTGTCGTCAGCTCGTGTCGTGAGATGTTGGGTTAAGTCCCGCAACGAGCGCAAGGGCAA |

FIG. 16AS

| | | | |
|---|---|---|---|
| Bifidobacterium_long um_subsp_longum_F8_NCBI_FP929034 | Bifidobacterium_lo ngum | SEQ ID NO: 111 | CCCTCGCGCCCGTGTTGCCAGCGGATTATGCGGCGGAACCGCCGGGGTTAACTCGGAGGAAGGTGGGG ATGACGTCAGATCATCATGCCCCTTAGGCGTCGGGGATAACACGGGGAAACCTGTACCTGTACAACGGGATGCGACGCG GCGACGCGGAGCGGATCCCTGAAACGGTCGGTAATCAGGCACTCTGCAACTGACGTGCCGTGCTGCCGCCAGAGT GCTAGTAATCGCGAATCAGCAACGGCGGTGGCCTAACCCTGCCCGGGCCTTGATGTTGGGATGGCCTCAGTCATGAAAGT CCGGCAGCACCCGAAGCCGGTGGCCTAACCCTTGTGGGATGGAGCGGTCAAGTGGAGCTCGTAAGGTGAGGACTCATGAAAGT CGTAACAAGGTAGCCGTACCGGAAGGTGCGGCTGGATCACGTCCTT<br>AGGGTTCGATTCTGGCTCAGGATGAACGCTGGCGGCGTGCTTAACACATGCAAGTCGAACGGGATCCATCAGGCTTTG CTTGGTGGTGAGAGTGGCGAACGGGTGAGTAATGCGTGACCGACCTGCCCCATACACCGGAATAGCTCCTGGAAACGG GTGCTAATACCGGATGCTCCAGTTGATCGCATGGTCTCTGGGAAAGCTTTCGCGGTATGGGATGGGGTCGCGTCCTAT CAGCTTGACGGGCGGGGTAACGGCCCACCGTGGCCTACGGACCAGCAGTAGCCAACCTGGACCTGAAAGGGGGACCATTGGG ACTGAGATACGGCCCAGACTCCTACGGGAGGCAGCAGTGGGGAATATTGCACAATGGGGCGAGAGTGAGTTTACCGTTGAA GCCGCGTGAGGGATGGCGACCTCTTTGATCGGGTGTAAACCTCTTTTATCGGGAGAAGAAATGACGGATACCCGGAGAATAACGGTCTGGTCAGAGTGCGGATCGGTGGGCCAGTGAGTCCCATTTGACAGAATGCGTTAGCCCGGCTGCTTGAGGGGCCAGTGAGTCCCATTTGACAGAATGCGTTAGCCCGGCTGCTTGAGGGGCCAGTGAGTCCCATTTGACAGATGTGTAGATATGTGGGAAGAACACCAATGGCGAAG<br>GCGGTCCTTGGGGCCCGTTACTGACGCTGAGGAGCGAAAGCGTGGGGAGCAACAGGATTAGATACCCCTGGTAGTCCAC GCCGTAAACGGTGGATGCTGGAATCGCGGGATCTGGGTCGGCGGGCGGCGGAAGAAGAGTGGCGGATGACGTC GGGAGTAGCCAACGCAAGGCGATACCCGAAGAATACGGCCTTTCCCTTCCCTGCGGCACGTGCGGCGGCGGGGATAT GATGCAACGGCAGGGAGCATATACGGCCTTAAACAGACAGAGAGCTTACCGTTGCAGGTGCAGGTATACAAGGTGCTGCATGGCTGTCGTCAGCTCGTGTCGTGAGATGTTGGGTTAAGTCCCGCAACGAGCGCAACCCTCGCC CCGTGTTGCCAGCATTATGCCGGGGACTCACCAGGGGACAACGAAATGGCGGGCAGGAAGGTGGGGATGACGTC AGATCATCATGCCCCTTACGTCCAGGGCTTCACACATGCTACAATGGCCGGTACAACGGGATGCTACAAAGCGCAAGTGG<br>AGCGGATCCCAAAAGCCGGTCTCAGTCGGATCGCAGTCTGCAACTCGACTGCGTGAAGGTGGAATCGCTAGTAAT CGCGAATCAGCAACGTCGCGGTGAATCACGTCCGAAGCATCGTCACACACCGCCCGTCAAGTCATGAAGTCGGGTAG CCGGGTGTACCGAAGGTCGGCAAAGCGCTCGAACGGGATCAACTTCGAGTCCGTGAACCGGACAACCAACCAGGCTGGGCCCACCT |
| Bifidobacterium_long um_subsp_suis_YIT_NCBI_AB437360 | Bifidobacterium_lo ngum | SEQ ID NO: 112 | GGGTTTGATTCTGGCTCAGGATGAACGCTGGCGGCGTGCTTAACACATGCAAGTCGAACGGGATCCATCAAGCTTGCT TGGTGGTGAGAGTGGCGAACGGGTGAGTAATGCGTGACCGACCTGCCCCATACACCGGAATAGCTCCTGGAAACGGGGT GTAATGCCGGATGATCATGTCCAGTTGCATGGTCTCTGGGAGACCCAGGCGCCACCGGCCACCGCAAGCTTCGCGGTCCATCATGGGACT GAGATACGCGGCCCAGACTCCTACGGGAGGCAGCAGTGGGGAATATTGCACAATGGGCGCAAGCCTGATGCAGCGACGC CGCGTGAGGGATGACGGCCTTCGGGTTGTAAACCTCTTTTATCAGGGACGAAGCGAAAGTGACGGTACCCTGCGAATAA GCACCGGCTAACTACGTGCCAGCAGCCGCGGTAATACGTAGGGTGCAAGCGTTATCCGGAATTATTGGCGTAAAGGG CTCGTAGGCGGTTCGTCGCGTCCGGTGTGAAAGTCCATCGCTTAACGGTGGATCTGCGCCGGGTACGGGCGGGCTGGAG TGTCGCCTAGGGAGACTGGGGAGATATCCGGAATTCCTGGTGTAGCGGTGAAATGCGTAGATATCGGAAGAACACCAATGG CGAAGGCGGATCTCTGGGCCGTTACTGACGCTGAGGAGCGAAAGCGTGGGGAGCAAACAGGATTAGATACCCTGGTAGT CGTAAACGGTGATCGCTTACAGGAGTGTGGGCGCCCGTTCCGTGTGTGAGTTAAGCGATCCAGCATCAGTTCGGCCGCATT AAGGACACTAAAACTCAAAGAAATTGACGGGGGCCCGCACAAGCGGCGGAGCATGCGGATTAATTCGATGCAACGCGAAGG AACCTTACCAAGGCTTGACATGTTGCCGATCGGTCCGTAGAGATACGAGTTTCCCTTCGGGGACGGCAATACACAGGT GCTGCATGGCTGTCGTCAGCTCGTGTCGTGAGATGTTGGGTTAAGTCCCGCAACGAGCGCAACCCCTGTCCTATGTTG CCAGCATTAAGTTGGGCACTCTGTAGGGACTGCCGGTGACAAACCGGAGGAAGGTGGGGATGACGTCAAGTCATCA TGCCCCTTACGTCCGGGCTTCACGCATGCTACAATGGCCGGTACAACGGGATGCGACACTGCGAGTGGGAGCGGAT CCCAAAAACCGGTCTCAGTTCGGATCGCAGTCTGCAACTCGACTGCGTGAAGGCGGAGTCGCTAGTAATCG CGAATCAGCAACGTCGCGGTGAATGCGTTCCCGGGCCTTGTACACACCGCCCGTCAAGTCATGAAAGTGGGCAAGC TAGCCGTACCGGAAGGTGCGGCTGG |

FIG. 16AT

| | | | |
|---|---|---|---|
| Bifidobacterium_pse udocatenulatum_DSM_20438_NCBI_AB XX02000002 | Bifidobacterium_ps eudocatenulatum | ABXX02000002 | SEQ ID NO: 113 | (sequence) |
| Bifidobacterium_pse udolongum_subsp_p seudolongum_JCM_1205_NR_043442 | Bifidobacterium_ps eudolongum | NR_043442 | SEQ ID NO: 114 | (sequence) |
| Bifidobacterium_scar dovii_CCUG_13008_NCBI_AJ307005 | Bifidobacterium_sc ardovii | AJ307005 | SEQ ID NO: 115 | (sequence) |

FIG. 16AU

| | | | |
|---|---|---|---|
| Bifidobacterium_sp_HM2_NCBI_AB42527 6 | Bifidobacterium_sp_HM2 | AB425276 | SEQ ID NO: 116 | GGAATTCCCGGTGTAACGGTGGAATGTGTAGATATCGGGAAGAACACCAATGGCGAAGGCAGGTCTCTGGGCCGTTAC TGACGCTGAGGAGCGAAAGCGTGGGGAGCGAACAGGATTAGATACCCTGGTAGTCCACGCCGTAAACGGTGGACGCT GGATGTGGGGCCCATTCCACGGGTTCCGTCGTCAAGCTAACGCGTTAAGCGCTCCGCCTGGGGAGTACGGCCGCAAG GCTAAAACTCAAAGAAATTGACGGGGCCCCGCACAAGCGGCGGAGCATGCGGATTAATTCGATGCAACGCGAAGAACC TTACCTGGGCTTGACATGTTCCGACGATCGTCGTGTGAGATGTTAAGGTTCCCTTCGGGGCGGTGTCCCAGGTTGTGGT CGTCGTCAGCTCGTGTCGTGAGATGTTGGGTTAAGTCCCGCAACGAGCGCAACCCCTGTTGCCAGCATTCGCCCTACGT GATGGGCTTCACGCATCTACAACGATGCAACCGGACGACACGGACGACACCGCCTGGCATGCGAGCAGGAAGTGT CCAAGGCTTCACGCATCACACCGATGCAACGAGACGGTGACGGTCGTAGGGTGAGCAAGGATCGTGAAAACCGG TCTCAGTTCGGATTGGAGTCTGCAACTCGACTCCATGAAGTCGGAATCGCTAGTAATCGCGAATCAGCAACGTCGCGGT GAATGCGTTCCCGGGCCTTGTACACACCGCCGCTCAAGTCATGAAAGTGGGCAGCACC |
| Bifidobacterium_sp_HMLN12_NCBI_JF5 19685 | Bifidobacterium_sp_HMLN12 | JF519685 | SEQ ID NO: 117 | GGGTTCGATTCTGGCTCAGGATGAACGCTGGCGGCGTGCTTAACACATGCAAGTCGTAACATGAACGAGTGGCGAACGGGTGAGT AATGCGTGACCGACCTGCCTCATACAGTGGGATAATAGCTCCTGGAAATGCTGGATGTGGTAATGCCGGAATGGGGCCAT GGGATAGGTCCGCTCCTATCGGGGACTTGATGGCGGCGACCGGCTGGGAATATTGGAAGAGGCAGCAGTGGGGGAATATTGCACAATGGG GGCGAACCGGCCACATTGGGACTGAGATACGGCCCAGAGCCTGATGCAGCCATGCCGCGTGTGTGATGAAGGCCTTCG GGTTGTAAACCGCTTTCAGGAGGGAAGAAGCGAAAGTGACGGTATCCTGGAGAAGAAGCCCCGGCTAACTACGTGCCAGCAGC CGCGGTAATACGTAGGGTGCAAGCGTTATCCGGAATTATTGGGCGTAAAGAGCTCGTAGGCGGTTTGTCGCGTCGTCTGTGAAAACTCCGGGGCTTAACC CCGGGTGCAGCAGTGGGTACGGGCAGACTAGAGTGCGGCAGGGGAGACTGGAATTCCTGGTGTAGCGGTGGAATGCGCA GATATCAGGAGGAACACCGATGGCGAAGGCAGGTCTCTGGGCCGTCACTGACGCTGAGAAGCGAAAGCATGGGGAG CGAACAGGATTAGATACCCTGGTAGTCCATGCCGTAAACGGTGGGCACTAGGTGTGGGGGACATTCCACGTCCTCCG TGCCGCAGCTAACGCATTAAGTGCCCCGCCTGGGGAGTACGGCCGCAAGGCTAAAACTCAAAGGAATTGACGGGGGCC CGCACAAGCGGCGGAGCATGCGGATTAATTCGATGCAACGCGAAGAACCTTACCAAGGCTTGACATGTGCCGGATCG TCGTAGAGATACGGGTTCCCTTCGGGGCCGGTTCACAGGTGGTGCATGGTTGTCGTCAGCTCGTGTCGTGAGATGTTGGGT TAAGTCCCGCAACGAGCGCAACCCCTGTCACATGTTGCCAGCACGTAATGGTGGGGACTCATGTGAGACTGCCGGGGT CAACTCGGAGGAAGGTGAGGATGACGTCAAATCATCATGCCCCTTATGACCTGGGCTACACACGTGCTACAATGGCCGG TACAACGGGATGCGACGCGGTGACGTGGAGCTAATCCCAAAAAGCCGGTCTCAGTTCGGATCGCAGTCTGCAACTCG ACTGCGTGAAGTCGGAATCGCTAGTAATCGCGAATCAGCAATGTCGCGGTGAATACGTTCCCGGGCCTTGTACACACCGCCCGT CGTAACAAGGTAGCCGTACCGGAAGGTGCGGCTGATCACCT |
| Bifidobacterium_sp_M45_NCBI_HM6261 76 | Bifidobacterium_sp_M45 | HM626176 | SEQ ID NO: 118 | AACGGGAGAGGAGGATGCGTGACCGGTGNCCGATGAATAGCTCCTGGAAATGCTGGATGTGGGGGATGTTCC ACATGAGCGCATACCCAAGGCGTGGGACGGTTAGCCGCCTAGCGGCGAAAGGCTTTTGCGGCCTGCAGTAGGGCATCTAGAGACGGCCCAGAAC TCCTACGGAGGCAGCAGGGAATATTGCACAATGGCGAAAGCCTGATGAGCGACGGCCGCGTGAGAGATGAAGG GCTTCGGGTTGTAAACGCTTTTTGTTCAAGGAGCAAGCCCGTGGGGGCCATTGTTGAATAGAAGAAGAGTAGTCTGAGAAAGCAC CGGCTAACTACGTGCCAGCAGCCGCGGTAATACGTAGGGTGCAAGCGTTGTCCGGATTTATTGGGCGTAAAGGGCTCG TAGGCGGTAGGGAGACTGGAAGTGTAAGGTGTAACGGATAGAAACCACCCAATGGGAAGAACACCAATGGCCCAGAGGT CTCTTACTGACGCTGAGGAAGCGAAAGCATGGGGAGTGAACAGGATTAGATATACCCTGGTAGTCCACGCCGTAA ACGGTGGATGCTGGATGTGGCCCCCTTTACGGGTCATCAGTGCCGAAGCTACGGGCCAAGCTGGGGTGCAACGGGAT TACGGGGAGTCATGCATGCGGATTAATTGCACAATGGCAATGGCACATGCCGAGCGTCAGCAGGAGCAAGAACGGGGT CAGCGGCCCTTACGCGGCGAACTACGTGCCAGCAGCCGCCGGTAATACGTAGGGTGCACCTGGGGCTCCCGGGTTGCA GTGGTCGCATGCATGCATGCCGAGCGTCAGCAGGAGCAACGTGACTGCCCAGAGAGTGGTAGCGAGCGCAACGGAAGCAC CCGAAAAACCGGTCTCAGTTCGGATCGGAGTCTGCAACTCGATNGCNTGAAGTGCTGNCNGCTGAAATACGGCCCCAGAGAGTCNC ACGGTGAAATGCTTGATGGCGNAACGTTGAGCCCATGGCTTAACACGTGACGTGGGGATCA GCTTACCTGCGAACGATGAACGGGATCCCAGGAGCTTGCTCCTGGGTGAGATGTGAGAGTGGCGGAAGGTGAGTAATGCGTGACCG AAGATTTTGCGGTATGGAATGGGATGGGGCGTAATGCGGAAATACGGCCGATGCCGCCGATGCATTGCACCAGCAGCCCCTGGGG TAGCCGGCCTGGGAACACATGGCCGAACGCCGCTCGACTCCAGTGGCGCCCCACCATGGCTCNCTAGTAATCGCNNATCGNNATCA |

FIG. 16AV

| | | | |
|---|---|---|---|
| Bifidobacterium_sp_MSX5B_NCBI_HQ616382 | Bifidobacterium_sp_MSX5B | HQ616382 | SEQ ID NO: 119 | ATATTGCACAATGGGCGCAAGCCTGATGCAGCAGCCGCGTGCGGGATGACGGCCTTTG ACTGGGAGCAAGCCCTTCGGGGTGAGTGTACCTTCGAATAAGCACCGGCTAACTACGTGCCAGCAGCCGCGGTAATA CGTAGGGTGCAAGCGTTATCCGGAATTATTGGGCGTAAGTGCGCTCGTAGGCGGTTCGTCGCGTCCGGTGTGAAAGTCC ATCGCTTAACGGTGGATCCGCGCCGGGTACGGCGAGGCTTGAGTGCGGTAGGGAGAGACTGGAATTCCTGGTGTACG GTGGAATGTGTAGATATCCAGGAAGAACAACCAATGGCGAAGGCAGTCTCTGGGCCGTCACTGACGCTGAGGAGCGAAA GCGTGGGGAGCGAACAGGATTAGATACCCTGGTAGTCCACGCCGTAAACGGTGGATGCTGGATGTGGGAAGCATTCCA CGGTCTCCGTGTCGGAGCCAACGCGATGCGGAGCATCGCGAGCAATGCCCTTGGGTATTGCATGCAAGAACCTTACCTGGTCGTGACATGTT ACGGGGGCCCGCACAGAGGCGCATGGGGTGTCATCCGTGTTGCAGCAGTGGTGCATGGCTGTCGTCAGCTCGTGTCGT GAGATGTTGGGTTAAGTCCCGCAACGAGCGCAACCCTCGTGTTGTGCCAGCACGTCACAGTGGGGACTCACGGGG GACCGCCGGGGTCAACTCGGAGGAAGGTGGGGATGACGTCAAGTCATCATGCCCCTTAAAACCGGTCTCAGTTCGGATTGGA CTACAATGGCCGGTACAACGGGATGCGACACTGCGAGTGGAGCCAATCCCGAAAGCCGGTCTCAGTTCGGATCGCAGTCTGCAACTCGA GTCTGCAACTCCCATCATGAAGTCGGAATCGCTAGTAATCGCGGATCAGCATGCCGCGGTGAATACGTTCCCGGGCC TTGTGCACACCGCCCGTCAAGTCATGAAAGTGGGTAGCACCGGAAGCCGGTGGCCTAACCCTTCGGGAGGGAGCCGTCT AAG |
| Bifidobacterium_sp_TM_7_NCBI_AB218972 | Bifidobacterium_sp_TM_7 | AB218972 | SEQ ID NO: 120 | GCTGGCGGCGTGCTTAACACATGCAAGTCGAACGAGTGGCGAACTGGGTGCTTGAGTAATGCGTGACCGACCTGCCCATACA CCGGAATAGCTCCTGGAAACGGGTGGTAATGCCGGATGCTGAAAGTCGATGCTGAAAGTCGGTAATGCCGGATGCTCGCGTCATCAGCTT GATGGCGGGGTAACGGCCCACCATGGCGACCGGCGACCGGCCACATTGGGACTGAGA CGGGGATGAAACGCCTTCGGGTTGTAAACCGCTTTGATCGGGAGCAAGCAGTGTCACAATAAGCACCGGCTAAC TACGTGCCAGCAGCCGCGGTAATACGTAGGGTGCAAGCGTTATCCGGAATTATTGGGCGTAAAGGGCTCGTAGGCGGT TCGTCGCGTCCGGTGTGAAAGTGTAGATATCGGCAAGAACACCAATGGCGAAGGCAGGCATTGGGATCGGCGCTAAC TGACGCGAAGGAGCGAAAGCGTGGGGAGCGAACAGGATTAGATACCCTGGTAGTCCACGCCGTAAACGCTGGG TGCTAGGTGTGGGAGGCATCACCTTCCTGTGCCGCAGCTAACGCATTAAGCATTCCGCCTGGGGAGTACGGTCGCAAGACT GAAACTCAAAGGAATTGACGGGGGCCCGCACAAGCGGCGGAGCATGCGGATTAATTCGATGCAACGCGAAGAACCTTACC AAGGCTTGACATGTTCCGTGTTGGTGCCAGAGCTGGAAACGGCCATGCACAGGTGGTGGCATGGTTGTCGTCAGCTCGT GTCGTGAGATGTTGGGTTAAGTCCCGCAACGAGCGCAACCCTCGTCTTGTGCCAGCAGCACGTCTACGCCTTTAAGTC GAGCGGATCCTGTTCAGTTCGGGCTGAATGCCTGGGGAGACTGCCAAAGGGGCCATGTCATCACCATGGTAGTCCTAGTAATGCTGGGA TCAGCAACGCGGGGTGAATGCCGGTGAATACGTTCCCGGGCCTTGTACACACCGCCCGTCAAGTCATGAAAGTGGGTCGTC TCTAAAACGGCGCCTCTAAGGGCTACCGGCGACTTAAGTGCCGAAAGGCGCTACCCGCTGGCCCGAAAACCCCGCCCTCTAAAGGCTACCGGCGCGACTTAAGTGCAATCGGAGGATGGGGTACC TAGTGTCTCTGAAGCTCGAAACTGCTAGCATGGCTACGCAGGCGGGGGGGTGTCAGCTCCTGAACTCTGAACATGCTTCTG AAGATGCGCTGGTGTAAACCTGTACGCGAGCCAACCGTGTCGGAGCCAACGCGGTGAATACGTTCCCGGGCCTTGTACACCG CCGCCCGTCAAGTCATGAAAGTGGGTCGTCAACTCCGGAGCACCAATCCCGCCCTCTAAAGGCTACCGCGGACTTAAGT CGCAAGCCGGGGGGCACAGCTGGAACGCTAAGCGGAGGATGAGATCCGGCTGGGATCTATCTGATGTCGGGTTAAGTC AAGAACCCTTACCTGGGGGAGGCCGCCAACCGTGTCGGAGCCAACGCGGTGAATACGTTCCCGGGCCTTGTACACACCG CCCGTCAAGTCATGAAAGTGGGTCGTCAACTCCGGAGCACCAATCCCGCCCTCTAAAGGCTACCGCGGACTTAAGT CGCAAGCCGGGGGGCACAGCTGGAACGCTAAGCGGAGGATGAGATCCGGCTGGGATCTATCTGATGTCGGGTTAAGTC CGCAAGCCGGGGGGCACAGCTGGAACGCTAAGCGGAGGATGAGATCCGGCTGGGATCTATCTGATGTCGGGTTAAGTC AAGAACCCTTACCTGGGGTGGATGCGCAACCGTGTCGGAGCCAACGCGGTGAATACGTTCCCGGGCCTTGTACACACCG CGGCCCGTCAAGTCATGAAAGTGGGCAACACCCGACTCGTGGAGCCAACCGTGTCGGAGCCAACGCGGTGAATACGTTCCCGGGCC AAGGTGGGGATGACGTCAAGTCATCATGCCCCTTATGATCCTGGGCTACACACGTGCTACAATGGCCGGTACAACGAGTC CGCAAGCCGGGGGGCACAGCTGGAACGCTAAGCGGAGGATGAGATCCGGCTGGGATCTATCTGATGTCGGGTTAAGTC CGCATCATGAAGCTGGAATCGCTAGTAATCGCGGATCAGCAATGCCGCGGTGAATACGTTCCCGGGCCTTGTACACACCG CCCGTCAAGTCATGAAAGTGGGCAACACCCGACTCGTGGAGCCAACCGTGTCGGAGCCAACGCGGTGAATACGTTCCCGGGCC AAGGTGGGGATGACGTCAAGTCATCATGCCCCTTATGATCCTGGGCTACACACGTGCTACAATGGCCGGTACAACGAGTC |

FIG. 16AW

| | | | |
|---|---|---|---|
| Bifidobacterium_ther mophilum_RBL67_N CBI_DQ340557 | Bifidobacterium_th ermophilum | DQ340557 | SEQ ID NO: 121 | GCTAGTAATCGCGGATCAGCACGCCGCGGTGAATACGTTCCCGGGCCTTGTACACACCGCCCGTCAAGTCATGAAAG TGGGTAGCACCGAAGCCGGTGGCCCAAGGGTGAGACTCGATTGGG TGGCTCAGGATGAACGCTGGCGGCGTGCTTAACACATGCAAGTCGAACGGGATCCTGCAAGCTTGCTTGCGGGTGAGA GTGGCGAACGGGTGAGTAATGCGTGACCAACCTGCCCCATGCTCCGGGATAAGCCTGGGAAACGGGTGGTAATGCCG ATGTGCCGGCTCCTCGCATGGGGTTGCGGGCCTGAGAGGCTAGCGGCCACATTGGGACTGAGATACG CGGGTGAGGGCGGCCACCAAGGCTTCGACGGTAGCCGGCCTGAGAGGGCGACCGGCCACATTGGGACTGAGATACG GGATGAGGGCCTCGGGTTGTAAACCGCTTTCAGCAGGGAAGAAGCCGAGAGTGTACTCTTTCGAATAAGCAC CGGCTAACTACGTGCCAGCAGCCGCGGTAATACGTAGGGTGCGAGCGTTATCGGAATTACTGGGCGTAAAGGGCTCG TAGGCGGTTCGTCGCGTCCGGTGTGAAAGTCCATCGCTTAACGGTGGATCTGCGCCGGGTACGGGCGAGGGCTGAGTG CGGTAGGGGAGACTGGAATTCCTGGTGTAGCGGTGGAATGCGCAGATATCAGGAGGAACACCAGTGGCGAAGGCAGGT CTCTGGGCCGTTACTGACGCTGAGGAGCGAAAGCGTGGGGAGCAAACAGGATTAGATACCCTGGTAGTCCACGCCGTA AACGGTGGATGCTGGATGTGGGGAGCAAGCTCCCGGGCCCTCCGTGTCGGAGCTAACGCGTTAAGCATCCCGCCTGGGGAG TACGGCCGCAAGGCTAAAACTCAAAGAAATTGACGGGGGCCCGCACAAGCGGCGGAGCATGCGGATTAATTCGATGCAA CGCGAAGAACCTTACCTGGGCTTGACATGTTGACATTGGTGTGAGAGATACTTGGGAAGGAGGAAGGTGACGGTCACAG GTGGTGCATGGCTGTCGTCAGCTCGTGTCGTGAGATGTTGGGTTAAGTCCCGCAACGAGCGCAACCCCTGCCCGCTGTGT GCCAGCAGCCGCCGGTAAGGCCGCAACTCGCAGGAAGGTGGGGATGACGTCAGAT CATCATGCCCCTTATGCCTGGGCTACACACGTGCTACAATGGCGGTCACAAGCGGAGGCGAACATGCCGTGAGGAGC GGATCCTGAAAAACCGCCTCAGTTCGGATCGAGCTCCGCGGCCTGCAACTCGCCTGCGAAGGCGGAGTCGCTAGTAATCGCG GATCAGCAACACCGCGGTGAATACGTTCCCCGGGCCTTGTACACACCGCCCGTCAAGTCATGAAAGTGGGCAGC |
| Blautia_coccoides_J CM_1395_NCBI_AB 571656 | Blautia_coccoides | AB571656 | SEQ ID NO: 122 | AGAGTTTGATCCTGGCTCAGGATGAACGCTGGCGGCGTGCTTAACACATCGAGTCGAGCGAAGCGCTATACAGAGATTT CTTCGGATTGAAGTCTTGTGACTGAGCGGCGGACGGGTGAGTAACGCGTGGGTAACCTGCCTCATACAGGGGGGATAA CAGTTAGAAATGACTGCTAATACCGCATAAGCGCACAGGGGCGCATGCCTCCTGTGCATCAAAGATTTGCATCGCTCCAAG ATGAGCCCGCGTCTGATTAGCTAGTTGGTGAGGTAACGGCTTACCAAGGCGACGATCAGTAGCCGGCCTGAGAGGGTGA ACGGCCACATTGGGACTGAGACACGGCCCAGACTCCTACGGGAGGCAGCAGTGGGGAATATTGCACAATGGGGGAAA CCCTGATGCAGCGACGCCGCGTGAAGGAAGAAGTATCTCGGTATGTAAACTTCTATCAGCAGGGAAGAAAATGACGGTA GGGTGTAAAGGGCAGCGTAGAGCAGAAGAGGTAAGCGGAATAGGACCCAGTACAGGGCTAACTACGTGCCAGCAGCCG CGGTAAGACGTAGGGTGCGAGCGTTGTCCGGAATTCCTGGGCGTAAAGGGGCGCGTAGGCGGACGATTAAGTCAGGAGAAC GCCAACTACGCGGCAGCCTGACACGTACGCAACTGGTGAGACTGGAGTGTCGGAGAGGAAAGTGGAATTCCTAGTGTAGCG GTGAAATGCGTAGATATATCGGAGGAACACCAGTGGCGAAGGCGGCTTTCTGGACGACAACTGACGCTGAGGCGCGAAAG CGTGGGGAGCAAACAGGATTAGATACCCTGGTAGTCCACGCCGTAAACGATGAGTGCTAGGTGTCGGGGAGCAAGCGCTCTCGG TGCCGCAGCTAACGCATTAAGCACTCCGCCTGGGGAGTACGGTCGCAAGATTAAAACTCAAAGGAATTGACGGGGACCCGC ACAAGCAGCGGAGCATGTGGTTTAATTCGAAGCAACGCGAAGAACCTTACCTACTCTTGACATCCTGCTAACGGAGATTGTTT TATCCTTAGTAGCCGCAAGTGTATCTCCTTTATGATCATGTAACGTGCACACAGGTGCTGCATGGCTGTCGTCAGCTCGTGTCG TGAGATGTTGGGTTAAGTCCCGCAACGAGCGCAACCCCTTATCGTTAGTTGCCATCAGTAACCGGGCATCTAGTTGGGACTGCT CGCTGAGACTGCCGGGGATAACCGGGAAGAAGGTGGGGATGACGTCAAATCATCATGCCCCTTATGATCTGGGCTACACACGT GTTGTTCTACCCGAAAGGGGAAAGCCAATCTGCAAGACAGCTCCCAAATATTCCATTATAAACGTCAGTCAAGGTCTACACGT TGCGGAATTCAAGAAAGCCAATCTGCAAGATCAAGCCAATCCCAGTTCGGATTGTAGTCTGCAACTCGACTACATGAAGTCGGAATC ATGAAGTAAGGTAGCCTAACCGCAAGGAGGGCGCTTACCACGGTGGGGTTCATGACTGGGGTGAAGTCGTAACAAGGTAGCCGT ACCGGAAGGTGCGGCTGGATCACCTCCTTT | 
| Blautia_glucerasea_ JCM_17039_NCBI_ AB588023 | Blautia_glucerasea | AB588023 | SEQ ID NO: 123 | AGAGTTTGATCCTGGCTCAGGATGAACGCTGGCGGCGTGCTTAACACATGCAAGTCGAACGAGAAACATTTAATGAAG CTTCGGATTAGTTTGTTTCTAAGCCAGTTAGTGGCGGACGGGTGAGTAACGCGTGGGTAACCTGCCTCACACTGGGATGG GTCAGAAATGACTGCTAATACCGCATAAGCGCACAGTGTTTTGTGTGAAAAACTCCGGTGTGTGAGATGG GCCACGCGTTGGATTAGCTAGTTGGCAGGGTAACGGCCCACCAAAGCGACGATCCATAGCCGGCCTGAGAGGGTGAACG GCCACATTGGGACTGAGACACGGCCCAGACTCCTACGGGAGGCAGCAGTGGGGAATATTGCACAATGGGCGAAAGCCTGA TGCAGCGACGCCGCGTGAAGGAAGAAGTATCTCGGTATGTAAACTTCTATCAGCAGGGAAGATAATGACGTTACCTGT ACTAAGAAGCACCGGCTAACTACGTGCCAGCAGCCGCGGTAATACGTAGGGGGCAAGCGTTATCCGGAATTACTGGGT GTAAAGGGAGCGTAGACGGCAGTGCAAGTCTGATGTGAAAGGCATGGGCTCAACCCATGGATTGCATTGGAAACTGT ACTGCTTGAGTGCCGGAGAGGCAAGCGGAATTCCTAGTGTAGCGGTGAAATGCGTAGATATTAGGAGGAACACCAGTGG CGAAGGCGGCTTGCTGGACGGTAACTGACGCTGAGGCTCGAAAGCGTGGGGAGCAAACAGGATTAGATACCCTGGTAG TCCACGCCGTAAACGATGAATACTAGGTGTCGGGGGAGCAAGCCCCTCGGTGCCGCAGCAGGCAACGCATAAGTATTCCGCCTGGGAG TACTGCTCGCAAGAGTGAAACTCAAAGGAATTGACGGGGACCCGCACAAGCAGCGGAGCATGTGGTTTAATTCGAAGCAACGCG AAGAACCTTACCTGATCTTGACATCCCACTGACCGGTAAAGCCTTGTATCCCTTTGAGGGTCAGTGGTGACAGGTGGTGCATGGT TGTCGTCAGCTCGTGTCGTGAGATGTTGGGTTAAGTCCCGCAACGAGCGCAACCCTTGTCTTTAGTAGCCAGCAGGTAAAGCTGG GCACTCTAGAGAGACTGCCAGGGATAACCTGGAGGAAGGTGGGGATGACGTCAAATCATCATGCCCCTTATGATTTGGGCTACA CACGTGCTACAATGGCGTAAACAAAGAGAAGCAAGACCGCGAGGTGGAGCAAATCTCATAAACCTTGTCTCAGTTCGGACTG CAGTCTGCAACTCGACTGCACGAAGCTGGAATCGCTAGTAATCGCGGATCAGCATGCCGCGGTGAATACGTTCCCGGGCCTTGT ACACACCGCCCGTCACACCATGGGAGCCGGGAACACCCGAAGTCAGTGAGCTAACCGCAAGGAGGGCGCTTACCACGGTAGGAT TCATGACTGGGGTGAAGTCGTAACAAGGTA |

FIG. 16AX

| | | | |
|---|---|---|---|
| Blautia_glucerasei_<br>NCBI_AB439724 | Blautia_glucerasei | AB439724 | SEQ ID NO: 124 | GATCTTGAGTACGGAGGGGTAAGCGTTACTCGGAATTCCTAGTGTAGCGGTGAAATGCGTAGAGATATTAGGAGGAACACCAGTGG<br>CGAAGGCGGCTTACTGGACGGTAACTGACGTTGAGGCTCGAAAGCGTGGGGAGCAACAGGATTAGATACCCTGGTAG<br>TCCACGCCGTAAACGATGAATACTAGGTGTCGGGAGTGTTGACCACTCGGTGCCGCAGCTAACGCAGTAATACCTGGGTTAATT<br>CTGGGAGTACGTTCGCAAGAATGAAACTCAAAGGAATTGACGGGACCCGCACAAGCGGTGGAGCATGTGGTTTAATT<br>CGAAGCAACGCGAAGAACCTTACCAAGTCTTGACATCCCTCTGACAGTGGTGGTTTGGGTTAAGTCACAGGAGACACGGTGGTT<br>GAGACAGGTGGTGCATGGTTGTCGTCAGCTCGTGTCGTGAGATGTTGGGTTAAGTCCCGCAACGAGCGCAACCCTTAT<br>CCCCAGTAGCCAGCATTTAAGGTGGCACTCTAGGGAGACTGCCGGGGATAAACCGGAGGAAGGTGGGGATGACGTCA<br>AATCATCATGCCCCTTATGATTTGGGCTACACACGTGCTACAATGGCTGAACTGTGCAACTCGAGACGAAGCTGCGACCGCGA<br>GCAAATCCAAAATAAGTCAGTCTCAGTTCGGATTGCAGGCTGCAACTCGCCTGCATGAAGCCGGAATCGCTAGTAATCGC<br>AGATCAGAATGCTGCGGTGAATACGTTCCCGGGCCTTGTACACACCGCCCGTCACACCATGGGAGTCGGTAACACCCGAA<br>GTCAGTGACCTAACCGAAAGGAGGGCGCCGAAGGTGACTGGGGTGAAGTCGTAACAAGGTAAC |
| Blautia_hansenii_AT<br>CC_27752_NCBI_A<br>BYU02000037 | Blautia_hansenii | ABYU0200003<br>7 | SEQ ID NO: 125 | CTCAGGATGAACGCTGGCGGCGTGCTTAACACATGCAAGTCGAACATGAGAGAAACATTTAATGATAGCTTCGGCAGATTTA<br>GTTTGTTTCTAGTGCGGACGGGTGAGTAACGCGTGGGTAATAACGTAACACTCGGGGATAACAGTCAGAAATGACTG<br>CTAATACCGCATAAGCGCACAGAACGCATGGTTTTGTGAGATGTGTGAGAGGGTGAAACGCGGTGATTGGGACT<br>AGCCAGTTGGGCAGGTAAGGCTACCAAGGCGACGATCCATAGCCGACCTGAGAGGGTGAACGGCCACATTGGGACT<br>GAGACAGCGGCCCAGACTCCTACGGGAGGCAGCAGTGGGAATATTCAAGCAATGGACGAAAGCCGGAATGACGCGGC<br>GCGCGTGAAGGAAGAAGTATCTCGGTATGTAAACTTCTATCAGCAGGGAAGATAATGACGGTACCTGACTAAGAAGCCCC<br>GGCTAACTACGTGCCAGCAGCCGCGGTAATACGTAGGGGCAAGCGTTATCCGGATTTACTGGGTGTAAAGGGAGCGT<br>AGAGGAGCCAGCCAAGTCTGATGTGAAAGGCAGGGCGCTTAACCCTGGGCATTGCATTGGAAACTGGCTAGCT<br>CTGAGCGGTAACGGGGAATTGTGCCGAAAGCGGGTAAAGCGCACATTGGGGGCAAAGTGCCGAAGCAGTGCCGAAGGAAGGAAGCTGGGGTAACG<br>CGATGAATACTAGGTGTCGGGAGCGGAGCAAGCGAGATCTACTCCGTGCCAAGCAGCAAAACGCAGTAATTCGCAGTCATC<br>TTAAGGTGTGGGCACTCGAGAGAGACTGCCGGTGTGGAAGCAACAGGATTAGATACCCTGGTAGTCCACGCCGTAAAC<br>GCATTTAAGGTGTGGGGACTCGAGAGAGACTGCCGGTGTCAAATCATCATGCC<br>CCTTATGATTTGGGCTACACACGTGCTACAATGGTTAACGGAAGATAACGTAATTGCAAATCATCATGCC<br>AATAACGTCGAATAGCTGTCCAGTTCGGATCTGCACTCTGCAACTCGAGTGCATGAAGCCGGAATCGCTAGTAATCGCAAATCAGAATGC<br>CGCGGTGAATACGTTCCCGGGTCTTGTACACACCGCCCGTCACACCATGGGAGTCAGTAATGCCCGAAGTCAGTGACC<br>TAACCGAAAGGAGGGCGCCGAAGGTGGGGCTGATGACTGGGGTGAAGTCGAAC<br>AGAGTTGATCCTGGCTCAGGATGAACGCTGGCGGCGTGCCTAACACATGCAAGTCGAGCGAAGCACTTACTTCATTGACT<br>CTTCGGAAGATTGATATTGCATAGTGCTAATGCGCGATCGAGCGAGCGCATCATTGTGCCTCATCAGGGAATAATAAC<br>AGTTAGAAAATGGCTGCTAATACCGGATAAGGTAGGTTGCATTAGGCGATGATCGATGATCGGCGGAGTCGAGTCGGCAATCGAGTGGCGATCGAGCGGCGAAAAC<br>GACCGCCCGCTCTGATTAGGGACTGAGGATAGTGGTGAAGCGATTAGTCGGCGGAGCAAGAACGCATCCGCGCCGCCAATCAGTCAGGAGAGCGGCAATCCGGC<br>CTGATCAGCGACGCCGTCGTAAGAAGAAGCTACGCCGCCAAGGAAGTATCCTATCTATACGTATAACGTAATAGGCTTACGGTACG<br>TGACTAAGAAGCCCGGCCAAGCAAGGCTAGCCAAGATCTGCGGGTACCGGCTGCGGTACCGGCTAACGCTTATCCGGATTTATTGGGCGTAAAGGGTGCGTAGGCCAAGTCAGTGACCGGCGGCGCAAAGATGGCCGAAGAAGAAGCTAAGGTAAGCTAACCCCGCCGCCAAGCCGAAGAAAGGCTAAGGTAACCTGGTA<br>GTCCACGCCGTAAACGATGAATACTAGGTGTCGGGGATGTTGTCAGCTCGTCGTGAGATGTTGGGTTAAGTCCCGCAACGAGCGCAACCCTTATTGTTAGTTACCAGCATGAAGCTTGGGCACTCTTAAGACAAGGCAAGCTGCCGAAGCAAGCAACGCAAACGGTGGGGATGACGTCAAATCATCCTCCATCCTAGCGGCGAAGCAACGGTGAAGTCAGCGCGGAGCTACCGAACCGACCCTAAGCCCCTATCTAGCGGCGAAGCAACGGTGGAGCTTCCTTCGGGACAGGAAGCTGGCTAGGCCGCCGCACCCGCCGCTCACACCATGGGAGCTGGGCACTCTAAGGTAAGCCGAAAGCGAGCCACATCCTAGCGGCGACCGATAACCGG |

FIG. 16AY

| | | | |
|---|---|---|---|
| Blautia_hydrogenotrophica_DSM_10507_NCBI_ACBZ01000217 | Blautia_hydrogenotrophica | ACBZ01000217 | SEQ ID NO: 126 | GAGAGTTTGATCCTGGCTCAGGATGAACGCTGGCGGCGTGCTTAACACATGCAAGTCGAACGAAGCGATAGAGAACGG<br>AGATTTCGGTTGAAGTTTTCTATTGACTGAGTGGCGGACGGGTGAGTAACGCGTGAGTAACCTGCCCTATACAGGGGGA<br>TAACAGTTAGAAATGACTGCTAATACCGCATAAGACCACACGGTCGCATGACCTGTGGTTAAAAACTGAGGTGGTATAG<br>GATGGGACCCGCGTTGGATTAGCTAGTTGGTGAGGTAAAGGCTCACCAAGGCGACGATCCATAGCCGGCCTGAGAGGGT<br>GAACGGCCACATTGGGACTGAGACACGGCCCAAATACTCCTACGGGAGGCAGCAGTGGGGAATATTGCACAATGGGGGA<br>ACCCTGATGCAGCGACGCCGCGTGAAGGAAGAAGTATCTCGGTATGTAAACTTCTATCAGCAGGGAAGAAAGTGACGGT<br>ACCTGTAAAGAAGCCCGCGGCTAACTACGTGCCAGCAGCCGCGGTAATACGTAGGGGGCAAGCGTTATCCGGATTTACT<br>GGGTGTAAAGGGAGCGTAGACGGTTTGGCAAGTCATGCGTGTCAACCTGTGGCTCAACCATGGGAGTGCATTGGAAAC<br>TGTCAGACTTGAGTGCCGGAGAGGCAAGCGGAATTCCTAGTGTAGCGGTGAAATGCGTAGATATTAGGAGGAACACCA<br>GTGGCGAAGGCGGCTTGCTGGACGATAACTGACGTTGAGGCTCGAAAGCGTGGGGAGCAAACAGGATTAGATACCCT<br>GGTAGTCCACGCTGTAAACGATGAATACTAGGTGTCGGGTGGCAAAGCCATTCGGTGCCGCAGCAAACGCAATAAGTAT<br>TCCACCTGGGGAGTACGTTCGCAAGAATGAAACTCAAAGGAATTGACGGGGACCCGCACAAGCGGTGGAGCATGTGGT<br>TTAATTCGAAGCAACGCGAAGAACCTTACCAAGTCTTGACATCCCTCTGACCGGATCTTAACCGATCCTTCTCTTCGGAA<br>CAGAGAGACAGGTGGTGCATGGTTGTCGTCAGCTCGTGTCGTGAGATGTTGGGTTAAGTCCCGCAACGAGCGCAAACC<br>CTTATCTTTAGTAGCCAGCAGGTTAAGCTGGGCACTCTAGAGACACTGCCGGGACAAGCCGGAGGAAGGTGGGGATG<br>ACGTCAAATCATCATGCCCCTTATGATTTGGGCTACACACGTGCTACAATGGCGTAAACAAAGGGAAGCGAAATCGTGAGA<br>ATGGAGCAAATCTCAAAAATAACGTCTCAGTTCGGATTGTAGTCTGCAACCCGACTACATGAAGCTGGAATCGCTAGTA<br>ATCGCGAATCAGAATGTCGCGGTGAATACGTTCCCGGGCCTTGTACACACCGCCCGTCACACCATGGGAGTCAGTAACG<br>CCCGAAGTCAGTGACCCAACCGAAAGGAGGGAGCTGCCGAAGGTGGGACTGATAACTGGGGTGAAGTCGTAACAAGGT<br>AGCCGTATCGGAAGGTGCGGCTGGATCACCTCCTTTCT |
| Blautia_luti_DSM_14534_NCBI_AB69157 | Blautia_luti | AB691576 | SEQ ID NO: 127 | CTGGCTCAGGATGAACGCTGGCGGCGTGCTTAACACATGCAAGTCGAACGAAGCCTTATACGGGAGTCTTCGGTSGAT<br>TAATTTAATTCTAGTGGCGGACGGGTGAGTAACGCGTGAGGAATCTGCCTATACAGGGGGATAACAGTTCAGAAATGA<br>CTGCTAATACCGCATAAGCGCACAGAGCTGCATGCTCTGGTGTGAAAAACTCCGGTGGTATAAGATGACACAGCAGTG<br>ATTAGCTRGTTGGTGGGGTAACGGCCCACCAAGGCGACGATCCATAGCCGGCCTGAGAGGGTGAACGGCCACATTGG<br>GACTGAGACACGGCCCAGACTCCTACGGGAGGCAGCAGTGGGGAATATTGCACAATGGGCGAAAGCCTGATGGCAGCG<br>ACGCCGCGTGAGCGATGAAGGAAGAAGGTTTCGGCTCGTAAAGCTCTGTCCTCAGGGACGATAATGACGGTACCTGAGG<br>AAGAAGCCCCGGCTAACTACGTGCCAGCAGCCGCGGTAATACGTAGGGGGCAAGCGTTGTCCGGAATTACTGGGTGTA<br>AAGGGTGCGTAGGCGGCAATGCAAGTCTGAAGTGAAAGGTAGATATTTGAAAACTGTTTTTAAGAGGAACCCAGCAGGC<br>TTACTGACGGGTAACTGACCGTTGAGGCTCGAAAGCGTGGGGAGCAAACAGGATTAGATACCCTGGTAGTCCACGCCGT<br>AAACGATGAATGCTAATACCGCATAAGCGCACACAGAGCTGCATGCTCTGGTGTAAGATGACAGCAGTGGTTAATTCG<br>CGATGCAAGCATTACCAAGACCTCGCTCGCGCATGGTCAGCTGCATGGTCGATGAACTCTGTGACCAGGAGGACAGGTG<br>GTGCATGGTTGTCGTCAGCTCGTGTGTGAGATGTTGGGTTAAGTCCCGCAACGAGCGCAACCCCCTATCCTCAGTAGCC<br>AGCAGGTTAAGCTGGGCACTCTGAGGAGACTGCCAGGGATAAACCGAAKGTGAASATGGAGCTGGATCAGAAT<br>AAAATCCAGTAACGATGTTGGCAAGCATGCAATGGGCAAGCGAATCGCTAGTAATCGYCATACTTGAGT<br>GCCGAGAGGGTGTAACTGACGGGGAATTCGCCAGGAGCACTCGGCAGGTAAACGATGAGTCGCATGTGGTTAATTCG<br>TTACTGACGGTAACTGACCGTTGAGGCTCGAAAGCGTGGGGAGCAAACAGGATTAGATACCCTGGTAGTCCACGGAGTA<br>AACGATGAATACTAGGTGTCGGGTGGCAATCGAGCAGCAGGATTAGATACCCTGGTAGTCCACGGAGTA<br>GTGCATGGTTGTCGTCAGCTCAGCTGCACTCTGAGAGACTGCCAGGGATAAACCCTATCCTCAGTAGCC<br>AGCAAGTTAAGTTGGGCACTCTGGGAAACTGCTAGGGATAAACCGGAGGAAGGTGGGGATGACGTCAAATCATG<br>CCCCTTATGACCTGGGCTACACACGTGCTACAATGGCGTAAACAAAGGGAAGCGAAGTCGCGAGGCTAAGCCAATCCCA<br>AAAATAACCCCAGTTCGGATTGCAGGCTGCAACTCGCCTGCACGAAGCTGGAATCGCTAGTAACGCGGATCAGCATGCC<br>GCGGTGAATACGTTCCCGGGTCTTGTACACACCGCCCGTCACACCATGGGAGTCAGTAATACCCGAAGTCAGTGA<br>CCTAACCGAAAGGAGGGAGCTGCCGAAGGCGGGACCGATGACTGGGTGAAGTCGTAACAAGGTAACC |
| Blautia_producta_ATCC_27340_NCBI_AB600998 | Blautia_producta | AB600998 | SEQ ID NO: 128 | AGAGTTTGATCCTGGCTCAGGATGAACGCTGGCGGCGTGCCTAACACATGCAAGTCGAGCGAAGCACTAAGACGGATTT<br>CTTCGGATTGAAGTTTTGTGACTGAGTGGCGGACGGGTGAGTAACGCGTGGGTAACCTGCCTCATACAGGGGGATAAGAT<br>CAGTTAGAAATGACTGCTAATACCGCATAAGACCACATGGTCGCATGACCATGTGGTTGAAAAACTCCGGTGGTATGAGAT<br>GGACCCGCGTCGTATTAGCTAGTTGGAGGGGTAACGGCCCACCAAGGCGACGATCCATAGCCGGCCTGAGAGGGTGAA<br>CGGCCACATTGGGACTGAGACACGGCCCAGACTCCTACGGGAGGCAGCAGTGGGGAATATTGCACAATGGGGGAAAC<br>CCTGATGCAGCGACGCCGCGTGAGCGACGAAGGCCTTCGGGTCGTAAAGCTCTATCAGCAGGGAAGAAAATGACGTTA<br>CCTGACTAAGAAGCCCCGGCTAACTACGTGCCAGCAGCCGCGGTAATACGTAGGGGGCAAGCGTTATCCGGATTTACT<br>GGGTGTAAAGGGAGCGTAGACGGAGTGGCAAGTCTGATGTGAAAGGCTGGGGCTTAACCCCAGGACTGCATTAGAAACT<br>GTTTTTCTTGAGTGCCGGAGAGGTAAGCGGAATTCCTAGTGTAGCGGTGAAATGCGTAGATATTAGGAGGAACACCAG |

FIG. 16AZ

| | | | |
|---|---|---|---|
| Blautia_producta_D SM_14466_NCBI_U NDETERMINED | Blautia_producta | UNDETERMINED | SEQ ID NO: 129 | TGGCGAAGGCGGCTTACTGGACGGTAACTGAACGGTTCGGGGAGCTCGAAAGCGTGGGGGAGCGAACAGGATTAGATACCCTGG TAGTCCACGCCGTAAACGATGAATACTAGGTGTCGGGTGGCAAGCCCATTCGGTGCCGCAGCAAACGCAGTAAGTATTC CACCTGGGGAGTACGTTCGCAAGAATGAAACTCAAAGGAATTGACGGGGACCCGCACAAGCAGCGGAGCATGTGGTTT AATTCGAAGCAACAGGCGAAGAACCTTACCAAGTCTTGACATCCCTCTGACCGGTCTAGAGATAGAGCCTTTCCTTCGGGGAC AGAGGAGACAGGTGGTGCATGGTTGTCGTCAGCTCGTGTCGTGAGATGTTGGGTTAAGTCCCGCAACGAGCGCAACCC TTATCCTTAGTAGCCAGCACATCATGATGGTGGGCACTCTAGGGAGACTGCCAGGGACAAAGGGAAGCGAGACAGCGAT GTCAAATCATCAGGAGGGATGGCGTCTACACGTGCTACAATGGCGTATACAAAGGGAAGCGAAATCGCGAGGA GTTGAGCGAATCCAAAATAACGCGTCGGTAGCCAGCTTCGGGACTGCAGTCTGCAACTCGACTGCGTGAAGTCGGAATCGCTAGTA ATCGCGGGATCAGAATTGCCGCGGTGAATACGTTCCCGGGTCTTGTACACACCGCCCGTCACACCATGGGAGTTGGTTGCACACCGAAGT GCCCGAAGTCAGTGACCTAACCGCAAGGAGGAGCTGCCGAAGGCGGGACGATAACTAGGGGAGTCGATAAGT GTAACC |
| Blautia_schinkii_B_N R_026312 | Blautia_schinkii | NR_026312 | SEQ ID NO: 130 | TCGAGCGAAGCAATTAAGTGGATCTCTTCGGATTGAAACTTATTTGACTGAGCGGCGGACGGGTGAGTAACGCGTGGGT AACCTGCCTCATACAGGGAATACTCCCTGATATCGCTAATACCGCATAAGCGCACAGAAGGCCACAGAGCGCATGCTCTGTG TGAAAAACTCCGGTGGTATGGAGGGTGAACGGCGGTGGGAGGAGGGGTAACGGCCCACCAAGGCGACGAT CAGTAGCCGGCCTGAGAGGTTGAACGGCCACATTGGGACTGAGACACGGCCCAGACTCCTACGGAGGCAGCAGTGG GGAATATTGCACATCGGGGACGCAAATGACGGTACCTGACTAAGAAGCCCGTGACGGTCAGCAACACCGCGTGACTGATCCTA CAGCAGGAAGAAATGACGGTTATCCGGATTTACTGGGCTGTAAAGCACAAGCCAGGAGAGCCAAGTGTGTATACGTGCTCTAT GGCAAGCGGTATCCGGATTTACTGGGCTGTAAAGCACAAGCCAGTGAAATGACGGGTATACGTGAAAGCTGGGGGTT AACCCCAGGACTGCATTGAAACTGTTTTTCTAGAGTGCGGGAGGCTTACTGACGGGTAACTGACGTTAAGCGGAATGC GTAGATATTAGGAGGAACACCAGTGGCGAAGGCGGCCTTACTGGACGGGATGGCATCCGGACGTGCGAAGCGTGGGGGA GCAAACAGGATTAGATACCCTGGTAGTCCACGCCGTAAACGATGAATACTAGGTGTCGGGTGGCAAGCCATTCGGTGC CAAGCCAATCAATAAGTATTCCACCTGGGAGTATTCGCAAGAATGAAACTCAAAGGAATTGACGGGGACCCGCA CAAGCGGTGAGCATGTGGTTTAATTCGAAGCAACGCGAAGAACCTTACCAAGTCTTGACATCCCTGACGACTGGAAG AACGGGGGCCTTCCCTTCGGGGACAGAGGAGACAGGTGGTGCATGGTTGTCGTCAGCTCGTGTCGTGAGATGTTGGGTTAA AGTCCCGCAACGAGCGCAACCCCTATCCTTAGTAGCCAGCACGTCAAAGATGGGCACTCTAGGAGACTGCTACAATGGCGTAAA ACCGGAGGAAGCGACCTCGCGAGAGCAAGCGGACCGATGATGGATTCTAGGCTACAGTTTCACGTTGAATCATCCGTAAACCGACTG CAAAGGAATGCGTAGCCAGCAATGGCTAGCATGCCGCGGTGAATACGTTCCCGGGTCTTGTACACACCGCCCGT CACACCATGGGAGTCAGTAACGCCCGAAGTCAGTGACCCAACCNTTATAGG TGAACGCTGGCGGCGTGCTTAACACATGCAAGTCGANCGGAGATTGATTTAACAGAGACTTCGGTTGAAGTTGTTCTGA TCTTAGTGGCGGACGGGTGAGTAAGCACGGTAAGCCGCCTTGCCTGTACTGGGGATAACAGCCAGAAATGACTGCTAATA CGCATAAGCACGGAGCATGTCTTGTAGCGGGTAAAAACTCCGGTGGTACAGATGAGATGGAACCGCGTTGATTAGCTA GTTGGCAGGGTAAGGGCCTACCAAGGCGACGATCAGTAGCCGACCTGAGAGGGTGAACGGCCACATTGGGACTGAGA CACGGCCCAGACTCCTACGGGAGGCAGCAGTGGGGAATATTGCACAATGGGCGAAAGCCTGATGCAGCGACGCCG CGTGAAGGAAGAAGTATCTCGGTATGTAAACTTCTATCAGCAGGGAAGAAATGACGGTACCTGACTAAGAAGCCCCGGCT AACTACGTGCCAGCAGCCGCGGTAATACGTAGGTGGCAAGCGTTATCCGGATTTACTGGGTGTAAAGGGAGCGTAGA CGGTAGCAAGGTCTGAATGAAACGGGGTAGCAGGGCAAGGCTCAACCTGTGGACTGCATTCGAAACTGTTTAACTTGA GTGCAAGAGAGGCAAGCGGAATTCCTAGTGTAGCGGTGAAATGCGTAGATATTAGGAGGAACACCAGTGGCGAAGGCG GCTTGCTGGACTGTAACTGACGCTGAGGCTCGAAAGCGTGGGGAGCAAACAGGATTAGATACCCTGGTAGTCCACGC CGGTAACTGACGCTGAGGCTCGAAAGCGTGGGGAGCAAACAGGATTAGATACCCTGGTAGTCCACGCCGTAAACGATG AATACTAGGTGTCCGGGGGCAAAGGCCATTCGGTGCCGCAGCAAACGCAGTAAGTATTCCACCTGGGAGTACGTTCGCA AGAATGAAACTCAAAGGAATTGACGGGGACCCGCACAAGCGGTGGAGCATGTGGTTTAATTCCAAGCAACGCGAAGAA CCTTACCAAGTCTTGACATCCCTTCTTCCGCAACGAAACGAGAACAGGTGGTGCATGGTTGTCAGCTCGTGTCGTGAGA GGTTGTCGTCAGCTCGTGTCGTGAGATGTTGGGTTAAGTCCCGCAACGAGCGCAACCCTTATCCTTAGTAGCCAGCAGGT TGATTTGGGCACTCTAGGGAAACTGCCGGTGACAAACCGGAGGAAGGTGGGGATGACGTCAAATCATCATGCCCCTTA TGATTTGGGCTACACACGTGCTACAATGGCGTAAACAAAGGGAAGCAAGACCGCGAGGTCAAGCAAATCCCAAAATAA CGTTCTCAGTTCGGACTGCAGTCTGCAACTCGACTGCACGAAGCTGGAATCGCTAGTAATCGCGGATCAGTAATCGCGGATCAGCATGCCGCGG TGAATACGTTCCCGGGTCTTGTACACACCGCCCGTCACACCATGGGAGTTGGTAATGCCCGAAGTCAGTGACCTAACC CGAAAGGGAGGAGCTGCCGAAGGCGGGACCGATAGCTAGCCGTAACAAGGTAGCCGTATCGGAAGG |

FIG. 16AAA

| | | SEQ ID NO: | |
|---|---|---|---|
| Blautia_sp_M25_NC BI_HM626178 | Blautia_sp_M25 HM626178 | SEQ ID NO: 131 | ATAACAGCCAGAAATGACTGCTAATACCGCATAAGCGCACAGAACCGCATGGTTCGGTGTGAAAACTCCGGTGGTATA AGATGGACCGCGTTGGATTAGCTAGTTGGTGGGGTAAGGGCGACGATCCATAGCCGACCTGAGAGG GTGAACGGCCACATTGGGACTGAGACACGGCCCAGACTCCTACGGGAGGCAGCAGTGGGGAATATTGCACAATGGGG GAAACCCTGATGCAGCGACGCCGCGTGAAGGAAGAAGGTATCTCGGTATGTAAACTTCTATCAGCAGGGAAGATAATGAC GTACCTGACTGTAAGAAGAAGCACCCGGCTAACTACGTGCCAGCAGCCGCGGTAATACGTAGGGGGCAAGCGTTATCCGGATT TACTGGGTGTAAAGGGAGCGTAGACGGCAGCGCAAGTCTGATGTGAAAGGCAGGGGCTTAACCCCTGAACTGCATTGG AAACTGCTGTCTTGAGTGCCGGAGAGGCAAGCGGAATTCCTAGTGTAGCGGTGAAATGCGTAGATATTAGGAGGAACA CCAGTGGCGAAGGCGGCTTACTGGACGGTTGACTGACGCTGAGGAGCGAAAGCACAGGGAGCAACAGGATTAGATACC CTGGTAGTCCACGCCGTAAACGATGAATACTAGGTGTCAAGGAGCAAGCTCTTCGGTGTCGCCGCCAAACGCATTAAGT ATTCCACCTGGGGAGTACGATCGCAAGATTAAAACTCAAAGGAATTGACGGGACCGCGCACAAGCGGTGGAGCATGTG GTTTAATTCGAAGCAACGCGAAGAACCTTACCAAGTCTTGACATCCTGCTAACCCTGTAGAGATACAGGGTTCCCTTCGG GACAGGGAGACAGGTGGTGCATGGTTGTCGTCAGCTCGTGTCGTGAGATGTTGGGTTAAGTCCCGCAACGAGCGCAA CCCTTATCCTTAGTAGCCAGCAGGTCGAGCTGGGCACTCTAGGGAGACTGCCAGGGATAACCTGGAGGAAGGTGGGG ATGACGTCAAATCATCATGCCCCTTATGACCTGGGCTACACACGTGCTACAATGGCGTAAACAAAGGGAAGCGAAACCG CGAGGTGGGCAAATCCCAAAATCGCGTCCAGTTCGGATCGCAGTCTGCAACTCGACTGCGTGAAGCTGGAATCGCT AGTAATCGCGGATCAGAATGCCGCGGTGAATACGTTCCCGGGTCTTGTACACACCGCCCGTCACACCATGGGAGTCAG TAACGCCCG |
| Blautia_stercoris_NC BI_HM626177 | Blautia_stercoris HM626177 | SEQ ID NO: 132 | TGCAAGTCGAGCGAAGCGCTTACGACAGAACCTTCGGGTGAAGATGTAAGGGACTGAGCGGCGGACGGGTGAGTAAC GCGTGGGTAACCTGCCTCATACGGGGGGATAACAGTTGGAAACTGACTGCTAATACCGCATAAGCGCACAGCAT GATACAGTGTGAAAAACTCCGGTGGTATGAGATGGGCCCGCGTCTGATTAGCTAGTTGGAGGGGTAACGGCCCACCAA GGCGACGATCAGTAGCCGACCTGAGAGGGTGATCGGCCACATTGGGACTGAGACACGGCCCAGACTCCTACGGGAGG CAGCAGTGGGGAATATTGCACAATGGGCGAAAGCCTGATGCAGCGACGCCGCGTGAGTGAAGAAGTATCTCGGTATGT AAACTTCTATCAGCAGGGAAGAAATGCAATGTGACTAAGAGAGCCCCGGCTAACTACGTGCCAGCAGCCGCGGTAA TACGTAGGGGGCTTAACCCCGGGACTGCATTATCCGGATTTATTGGGCGTAAAGGGTGCGTAGGCGGAATCCTAAGTGTCGTTT CTGGGGCTTAACCCCAGATATTGGAAGATGAACGCAGTGGAGAATTAGAGCGGTAACGGCGAGTAACGCTGAGGCTCGAAA GTGAAATGCGTAGATATTAGGAGGGAACACCAGTGGCGAAGGCGGTTACTGGACGGTTACGGTTGACGGCGGCAAAAGC TCTTCGGTGCGCAGCAAACGCAATAGTATTCCACCTGGGGAGTATTGCACTCGCAAGAGCTGAAACGCAAAGGAATTGACG GGGACCCGCACAAGCGGTGGAGCATGTGGTTTAATTCGAAGCAACGCGAAGAACCTTACCAAGTCTTGACATCGATCTG ACCGGTTAAGTCCCGCAACGAAGGAGGACGCAGGTGGTGCATGGTTGTCGTCAGCTCGTGTCGTGAGATG TTGGGTTAAGTCCCGCAACGAGCGCAACCCCTATGATTAGTTGCCATCGTTAAGTCCCGCAACGAGCGCAACCCCTATGATCAGTTGCCATCGTTAAGTCCCGCAACGAGCGCAACCCCTATGATCAGTTGCCATCATT (unreadable) |
| Blautia_wexlerae_D SM_19850_NCBI_E F036467 | Blautia_wexlerae EF036467 | SEQ ID NO: 133 | CAAGTCGAACGAAGCACTTTATTGAAACTTCGGTGCTGATTTAATTTAAGTTCTAGTGGCGGACGGGTGAGTAACGCGTGG GTAACCTGCCTTATACAGGGGGATAAACGTCAGAAATGGCTGCTAATACCGCATAAGCGCATAGGCTCAG TGTGAAAAACTCCGGTGGTATAAGATGGGCCCGCGTCTGATTAGCTAGTTGGTGGTGTGAAGGGCCACCAAGGCAGCAGT ATCCATAGCCGACCCTGAGAGGGTGAACGGCCCACATTGGGACTGAGACACGGCCCAGACTCCTACGGGAGGCAGCAGT GGGGAATATTGCACAATGGGGGAAACCCTGATGCAGCGACGCCGCGTGAAGGAAGAAGTATCTCGGTATGTAAACTTCT ATCAGCAGGGAAGAAGTAGACGGTTACCTGTGCCAGCGGCAACTACGTGCCAGCAGCCGCGGTAATACGTAGG GGGGCAAGCGTTATCCGGATTTACTGGGTGTAAAGGGAGCGTAGGCGGTGCCAAGTGTGAAAGCATGGCATCAACCCTGTTGAGAAT TCAACTGGCAAGCTAGATATCGGCAGTGGCAGGTTACCGGACGGTTCCCGGGACGGTTCCCGGGACGGTTCCCGGAA CGTAGGGCAAACAGGATTAGATACCCTGGGTAGCCCCGACGTAAGCGGTGCCAAGGCAAGGATTAGATATACCCGAAAAGCCAG GAGCAAAACAGGATTAGATACCCTGGTAGTCCACGCCGTAAACGATGAATACTAGGTGTCAGGATGTCAAAGGCCATTCGG TGCACAAGCGGTGGAGCATGTGGTTTAATTCGAAGCAACGCGAAGAACCTTACCAAGTCTTGACATCCTGCTAACGAAGCA CTTAACCCGGATCTTCCTTCGGGACAGAGGCGACAGGTGGTGCATGGTTGTCGTCAGCTCGTGTCGTGAGATGTTGGGT |

FIG. 16AAB

| | | | |
|---|---|---|---|
| Butyrivibrio_fibrisolvens_1_230_NCBI_AJ270493 | Butyrivibrio_fibrisolvens | AJ270493 | SEQ ID NO: 134 | TAAGTCCCGCAACGAGCGCAACCCCTATCCTCAGTAGCCAGCATTTAAGGTGGGCACTCTGGGGAGACTGCCAGGGAT AACCTGGAGGAAGGAAGGCGAGGATGACGTCAAGTCATCATGCCCCTTATGATTTGGGCTACACAGTCGCAATGGCGTAA ACAAAGGCAGCGAGATTGTGAAAAGTTTTCCCAGTTCGGATTGTGGACACGTAGTCTGCAACCGACT ACACGAAGCTGGAATCGCTAGTAACGCCAAAATAACGTCCGGGATCAGAATGCCGCGCGGTGAATACGTTCCCGGGTCTTGTACACCGCCC GTCACACCATGGGAGTCAGTAACGTCGAAGTCGACCTAACTGGACCTCAGGGAGTGATAATCCGGGGGCTGCCGAAGCCGGGACCGATG ACTGGGGTGAAGTCGTAACAAGGT |
| Butyrivibrio_fibrisolvens_16_4_human_feaces_NCBI_AJ250365 | Butyrivibrio_fibrisolvens | AJ250365 | SEQ ID NO: 135 | GAGTAACGCGTGGGTAACCTACCTTGTACCTGACGATAAGGGGACAACAGTTGGAAACGACTGCTAATACCGCATAAGCGCACAGCA TCGCATGATGCAGTGTGAAAAGTTTTCGGTGAAAAGCTCTGATTAGCTAGTTGGTGAGGTAACGGCTCACCAAGGCGACGATCGGTAGCCGACCTGAGAA ACCAAGGCAGCAGATCAGTAGGGGAATATTGCACAATGGGCGAAAGCCTGATGCAGCAACGCCGCGTGAGTGATGACGGCCTTCGG GTATGTAAAGCTCTATCAGCAGGGAAGAATAATGACGGTACCTGTGGAATAAGCACCGGCTAACTACGTGCCAGCAGCCG CGGTAATACGTAGGTGGCAAGCGTTATCCGGATTTACTGGGTGTAAAGGGTAAAGCAGGCGGTTAACAAGTCTGATGTG AAAGCCCGGGGCTCAACCTCGGTATTGCATCAGAAACTGTTTAGCTAGAGTGTCGGAGAGGCAAGCGGAATTCCTAGTGT AGCGGTGAAATGCGTAGAGATTAGGAGGAACACCAGTGGCGAAGGCGGCTTGCTGGACGATAACTGACGCTGAGGCT CGAAAGCGTGGGGAGCAAACAGGATTAGATACCCTGGTAGTCCACGCCGTAAACGATGAATGCTAAGTGTTGGGAGGCT TAGGGAGTCGGTGCCGCAGCTAACGCAATAAGCATTCCACCTGGGGAGTACGTTCGCAAGAATGAAACTCAAAGGAATT GACGGGGACCCGCACAAGCGGTGGAGCATGTGGTTTAATTCGAAGCAACGCGAAGAACCTTACCAAGTCTTGACATCCCT CTTGACAAAGTATGTAATGTACCTTCCGGAAGGACGGACAGGTGGTGCATGGTTGTCGTCAGCTCGTGTCGTGAGATGTTGGGTTAAGTCCCGCAACGAGCGCAACCCTTATCTTTAGTAGCCAGCATCATATGATTTGGGCACTCTAGAGAGAC TGCCCGGGTGAACCGGAGGAAGGTGGGGATGACGTCAAGTCATCATGCCCCTTATGACTAGGGCTACACACGTGCTA CAATGGCGAGTACAGAGGGCAGCTAAATCGCGAGGCGGAGCCAATCCTAAAAATAACTCGAGATGCGGGTGAAT CAACTCGACTACATGAAGCTGGAATCGCTAGTAATCGCGAATCAGAATGTCGCGGTGAAT |
| Butyrivibrio_fibrisolvens_ATCC_19171_NCBI_U41172 | Butyrivibrio_fibrisolvens | U41172 | SEQ ID NO: 136 | ACGATCCCCTTCGGGGTGACGATTTGTTGACTGAGTGGCGGACGGGTGAGTAACGCGTGGGTAACCTACCTTGTACAGG GGGACAACAGTTGGAAACGACTGCTAATACCGCATAAGCGCACAGCTTCGCATGAAGCAGTGTGAAAAGTCGCACGATGAGA ACAAGATGGACCCGCGTCGCATTGGGACTGAGATAGGCGCACCGCGAATGGACAAGCCACCGCCTACGGCAGCAGTGGGAATATTGCACAATG GGCGAAAGCCTGATGCAGCAACGCCGCGTGAGCGAGGAAGGTATGTAAAGCTCTATCAGCAGGGATGATG ACGGTACCTGACTAAGAAGCACCGGCTAACTACGTGCCAGCAGCCGCGGTAATACGTAGGTGGCAAGCGTTATCCGGAT TTACTGGGTGTAAAGGGTGCGTAGGCGGCTTAACAAGTCTGATGTGAAAGGCTGGGGCTCAACCCCAGTTAGCATCATT GAAACTGTTAAGCTAGAGTACAGAAGGAGGTAAGCGGAATTCCTAGTGTAGCGGTGAAATGCGTAGATATTAGGAGGAACACC AGTGGCGAAGGCGGCTTACTGGACTGTTACTGACGCTGAGGCGCGAAAGCGTGGGGAGCAAACAGGATTAGATACC CTGGTAGTCCACGCCGTAAACGATGAATGCTAGGTGTTGGGGAGCAAGAGCTCAGTGGCTGAATCGCTAGTA ATCGCGAATCAGAATGTCGCGGTGAATACGTTCCCGGGTCTTGTACACACCGCCCGTCACACCATGGGAGTTGGGAAGT CCGAAGTCGTGACCCGAACCTCAAGGGAGGCAGCCGTCGAAGGTGGGATCGATGATTGGGGTG |
| | | | | TGGCGGCGTGCCTAACACATCGAAGTCGAACAGGAGTTATTGCTGATGAAGCTTCGGCAGAATCTTGAATAACTTAGTG AGCGGCACAGCGTCGCATGAACGCTGATGAAGGATAAGCAGTTGGAAACGACTGCTGAAAACGACCGGCATA GGTAACACAGTGCGCATGACCAAAGGGTGAAAATATTTATAGGTACGAGATAGGCCGGACGGGGACGACGCGGTGTGA AAACTCCTACGGCGGAGGCAGCAGTGGGGATATTGCACAATGCGACAGCCTCATGCAGCGACGCCGCGTGAGTGAA GAAGTATTTCGGTATGTAAAGCTCTATCAGCAGGGAAGAAACTCGTAAGGAAGAAACCTGTAGGGAGTGACGGTACCTGAGT AAGCCACCGGCTAACTACGTGCCAGCAGCCGGGGTAATACGTAGGGGCCAAGCGTTACTCGGAATTACTGGGCGTA AAGGGCGCGTAGGCGGCTGCTGTATGCAGGGGATCGTCTACGCTGGGCGTATGGGATGATCGATAACGCTTAGA GGTAGAGGGGAGGTAGAGTACGAGCAGGGGAAGGTGGAATTCCATGTGTAGCGGTGAAATGCGAAGATATTTATGGGAACACCAGGAGG CGAAGCCGGCCCTCTGGGCTGTTACTGACACTGAGGCGCGAAAGCTAGGGTAGCGAACGGGATTAGATACCCGGTAG TCCTAGCCGTAAACGATGGATACTAGGGTGTGGGGGGGCTTAGGCCCTTCCTGTTGCAGCGCTAACGCATTAAGTATCCCAC CTGGGGAGTACGGTCGCAAGACCAAAACTCAAAGGAATTGACGGGACCCCGCACAAGCGGTGGAGCATGTGGTTTAATT CGATGATACGCGAGGAACCTTACCAAGGCTTGACATCGTTAAGTCAAGCTGTAAACGGATGAATCGCGGTAGTA GCGAGACGGGTATCAAGTCAAGTCGAGCATGGTTGTCGTCAGCTCGTGTCGTGAGATGTTGGGTTAAGTCCCGCAACGA GCGCAACCCCAACCGTGTATCAAGTTGCCAGCATTGAGTTGGGACTCTTGGTGAGAGGAT |

FIG. 16AAC

| | | | |
|---|---|---|---|
| Catonella_genomos p_P1_oral_clone_M B5_P12_NCBI_DQ0 03629 | Catonella_genomo sp_P1_oral_clone | DQ003629 | SEQ ID NO: 137 | ACTGGAGGAGTAAGCAACGTGGAATTCCTGGTGTAGTAGTGAAATGCGTAGATATCAGGAGGAACATCAGTGGCGAAGGCGGC TTACTGGACGAACTGACGTTGAGGCTTGAAAGCGTGGGGAGCAACAGGATTAGATACCCTGGTAGTCCACGCCGT AAACGATGAATACTAGGTGTTGGGAGCAACATAGTCTTCAGTGCCGAAGCTAACGCAATAAGTATTCCACCTGGGAGTA CGTTCGCAAGAATGAAACTCAAATCTTGAGATCTGAGTCGTGTGAGATCCTTCGGGAGCATGGAGACAGGTG CGAAGAACCTTACCAAGTCCAGATGAATGATGGGGATAATGTTGGGTAACGATCTCCCGAACGAGCGCAACCCTTGTCCATGTAGCC AGCAGTAAGATGGGACTCTATGGAGACTCGCCAGGGGATAACTGGACGAAGGAAGCTGACGTCAAATCATCATGC CCTTATGATTTGGGACCACACAGTGCTACAATGTCGTACACACGAGTGGGAACACCGAAAACTGTAAAACTTCCAAA ATAACGACCCAGTTCGGATTCGAGACTGTAGGCCGATATCGTGTACACACCGCCCGTCACACACTGGGAGTGAATGCGCCAAAGTCAGATGCCT GGGGTAATACGGGTCCGGCTGGAATCGCGGGTGTGACTGGCGATTCGGGAATGTGGGAATCGTAGTCGGAGCTGGACCCACTAAGCGGACGCC AACGTAAGGAGGAGCTTGCTAAGGACAGGTCGGATAACTCGGGTGAACTGGTAACAAGGTAGCC |
| Catonella_morbi_AT CC_51271_NCBI_A CiL02000016 | Catonella_morbi | ACiL02000016 | SEQ ID NO: 138 | ATGAGAGAGTTTGATCCTGGCTCAGGACGAACGCTGGCGGCGTGCCTAATACATGCAAGTCGAACGCGACTGAGT GCTTGCACTTGGTCAAGTGAGTGGCGAACGGTGAGTAACGTGGGTAACCTACCTCATAGTGGGGATAACAGTC GGAAACGACTGCTAATACCGCATAAGCGCATGGCATCGCATGATTCTGTGAGGAAAGGTGGCGCAAGCTATGCTAAGAG ATGGGCCCACATTGGACTAGCTAGTAGGTGGGGTAAGGCCTACCAAGGCGATGATCGATACTCCGCCAATGGACGCGAA GTCTGACGGGAGCAAACCGCGCGCGTGAGTGAAGAGACTCTTGTGTTAGAGAAGAACAGCGCATA GAGTAACTGCTATGCGTGTGACGGTACTCTAACCAGAAAAGGAGGGTAGGCGGTGAAAGGCTAATACGGCT CAACGCGAGCGTTCGGGAGGTTCATTGAAAACTGAAGTGCGAGAGGAGAGCGGAATTCCATGTGTAGCGGTGAAAT GCGTAGATATATGGAAGAACAGGAGACCTTGAGGCGAAGGCGGCTCTCTGGAACCTGTAACTGACGCTGAGGCGCGAAACGTGGG GAGCAAACAGGATTAGATACCCTGGTAGTCACGCCGTAAACGATGAGTGCTAAGTGTTGGGGTTCACTCCAAGAGCCGGCTCAAG TGCTGGAGTTAACGCGATTAAGCACTCCGCCTGGGGAGTACGCAGCAAGGCTGAAACTCAAGGAATTGACGGGGACC CGCACAAGCGGTGGAGCATGTGGTTTAATTCGAAGCAACGCGAAGAACCTTACCAGGTCTTGACATCCGTGTCGTGGAGATGTTGG TTAAGTCCCGCAACGAGCGCAACCCCTATAACTAGTTGCCAGCAGGTGGGACTGCTAGTTAGACTGCCGGTGACA AACCGGAGGAAGGTGGGGATGACGTCAAGTCATCATGCCCCTTATGACCTGGGCTACACACGTGCTACAATGGTTA CAACCAGCAGCGGAATCGCGAGTAATCGCGGACGAGCCCGAAACGGGTCCAGTTCGGATTACGGGATCAAGCGACTGGTA TCAACCAGAGTTTGTAACAACCGAATCGCGGAGCCGTCACACCATGGGAGTTGGGATAGATG ATTGGGGTGAAGTCGTAACAAGGTAGCCGTATCGGAAGGTGCGGCTGGATCACCTCCTTCT |

FIG. 16AAD

| | | SEQ ID NO: | |
|---|---|---|---|
| Catonella_morbi_NC BI_GU406953 | Catonella_morbi | GU406953 | SEQ ID NO: 139 | GATGAACGCTGGCGGCGTGCCTAACACATGCAAGTCGAACGGAGATTACGGAGACGGAAGTTTCGGATGGAAGACTGTA ATTCTTAGTGCGGAAGCGGGTGAGTAACGCGTGGGCAACCTGCCTGTCACAGCGGGATAACAGCTAGAAATGGCTGGTA AGACCGCATAAGTCGGCGGAACCGCATGGTTTGTGCGGAAAATGAGCAATCAGGTATAGGATGGACCCGCTCCGATT AGCCAGTTGGCAGGCCCAAACTCCTACGGGAGGCAGCAGTGAGGAATATTGCACAATGGGCGGAAGCCTGATGCAGCGACGC TGAGACACGGTCCAGACTCCTACGGGAGGCAGCAGTGAGGAATATTGCACAATGAAGCTCTGATGCAGCGACGC CGCGTGAGTGAAGAAGGTATGTCGGTATCGGGAAGCAAGCGTTATCAGCGGAAGATGACGGTTATCAGGGTTATCCGGATTTAC CGGTAACTACGTGCCAGCAGCCGCGGTAATACGTAGGGGGCAAGCGTTGTCCGGAATTACTGGGCGTAAACGTAAAACTTCAGTATG CAGGGGAAGCAGGCGGAATTCCTAGTGTAGCGGTGAAATGCGTAGATATTAGGAAGAACACCGGTGGCGAAGGCGGCCTG CTGGACAAAACTGACGCTGAGGCTCGAAAGCGTGGGGAGCAAACAGGATTAGATACCCTGGTAGTCCACGCTGTAAAC GATGAATACTAGGTGCTGCGGGAGGAATTGACGGGGAGTATGCGCAAACGTGAGAGCATCCTCCTGGGGGAGTACGTTGTCAAGCGTCAGCAAGTCG TCCCGAGAATCAGAGGCATCCAAGCCTTTGACGGGATTCCGCAAATGCTGAAGCTTCAGCGTCAGCAAGTACGG AAAGAACCCTTACCCGGCAGCAGCCGCGGTAATACGAGGGTCCGGAATATTTGGGCGTAAAGCGCGCGTAGGCGGTGCGCGCAGGGCG GTGGTGCATGGGGGCGGGGCCCCCAGACGTAGAGGAAGAAGGGGTTATCCGGATCCCTAGTGTAGCGGTGAAATGCGTAGATATTAGGAGGGAACACCAGTGGCGAAGGCGGCCCTG AGCCAGGGGTAGGGCGCGGATATACGGGGGAAGCGTAAGCCTTAACCTCTTGACGGCGGCGCATCCGGGGGGGAAGCGAGGGGCGTTCCCGAATCCGAATGCCCCCTATTCTTAGT ATCATCATGCCTCTTATGACCGGGTCGTGGGCTCGGGAGGTGCA |
| Catonella_sp_oral_cl one_FL037_NCBI_A Y349369 | Catonella_sp_oral_cl one_FL037 | AY349369 | SEQ ID NO: 140 | GAGTTTGATCCTGGCTCAGGATGAACGCTGGCGGCGTGCCTAACACATGCAAGTCAAGCGAACAGCGGTGGTGAGT AACGCCGTGGGAATCTGCCCGTGAACCCGGGATACACAGGGGGAAAATGAGCGCATAAGACAACACCGCATAAGAAAACTGGTAT GGGATGGACCCGCCCGCGCATTGGGACTGAGACACGGCCCAGACTCCTACGGGAGGCAGCAGTGGGGAATATTGCACAATGGG CGAAAGCCTGATGCAGCGACGCCGCGTGAGTGAAGAAGGCCTTCGGGTTGTAAAGCTCTTTCAGCAGGGAAGATGACGG TACCCTGAATAAGAAGCACCCGGGCTAAGCCTACGTGCCAGCAGCGCGGTAAATACGTAGGGGGGCAAGCGTTATCCGGATTTAC TGGGCGTAAAGGGGGGGGGCAGGAGGGTTCTCGGCAAGTCCAGGGAGATCGACGCGGGCGGGCTTGAGATCGACGCCTCCCCAAA ACTGTTGAACCCTTTGGGGGGGGGGGAAGGCGCTGAGGCGGGGCGGTTCTCAGACGTAGAGGCGTGAAATGCGTAGATATTGGGAAGAACACCCTG GTAGCGGAAGGCGGCCCGCTGGTAAACCTGACGCTGAGGCGCGAAGCGTGGGGAGCAAACAGGATTAGATACCCTGG TACTACGTCGGACTACGGGGGGAGCAGGGCGTAAACGATGAATACTAGGTGTCGGGGGGGGGGGCATTGAGTGATTCCACCTGGG GCAAGCGTTAACCCGCCAAGCGGATCGTGGTGTAAAGATGCAGGGAGACTTCCGCCCCGTCTCAGTTCAGCAGCAGCAGCCCGCACCAT GCAAGGGGAAGCGAGGGTGAAATCAGCAGCAGCCTATTAGATTGTAGCGGTGAAATGCGTAGATATTGCGAAGAACACCAGTGGCGAAGGCGGTCTGG GGTTAAGTCCGCAAACGAGCGCAACCCCTATTGTTAGTTAGCGCCGAGATCCTTCCAGACCGCGGGGGAAGCGGCGTAATCATTAAGCCAGCTAA TGGGCGCAAACGGAATTGAAACTTACCCTCCTCATCAGCAGAGCCGGAGCAGCCCCGCAAGCCGTACCGATAAGGCGCGACAGTAAGCGATAGGCG GGATCGGGGGGATAATCGCAAGTACAAGCATGCCGCTATGCGGAATCGACGGCGGCGGGATGACCAAATAACT CCGGAGGAAGGTGGGGGATGACGTCAAGTCATCATGCCCCTTAATGACCAGGCGCAGGGCAAACCAGCCAAGT TGGAGCCGTAATCGCAAGTGCAGCATGCCCGCTATGCGGAATCGACGGCGGCTCAGGTCAAGGCCAGCCAGCACCAT GGAGCCCGTATCGCGAAGGTGCGGCTACGGGATAACACT |
| Citrobacter_youngae _ATCC_29220_NCB I_ABWL02000011 | Citrobacter_young ae | ABWL0200001 1 | SEQ ID NO: 141 | TTAAATTGAAGAGTTTGATCATGGCTCAGATTGAACGCTGGCGGCAGGCCTAACACATGCAAGTCGAACGGTAGCACAG AGAGCTTGCTCTCGGGTGACGAGTGGCGGACGGGTGAGTAATGTCTGGGAAACTGCCTGATGGAGGGGGATAACTACT GGAAACGGTAGCTAATACCGCATAACGTCGCAAGACCAAAGAGGGGGACCTTCGGGCCTCTTGCCATCGGATGTGCCC AGATGGGATTAGCTTGTTGGTGGGGTAACGGCTCACCAAGGCGACGATCCCTAGCTGGTCTGAGAGGATGACCAGCCA CACTGGAACTGAGACACGGTCCAGACTCCTACGGGAGGCAGCAGTGGGGAATATTGCACAATGGGCGCAAGCCTGATG CAGCCATGCCGCGTGTATGAAGAAGGCCTTCGGGTTGTAAAGTACTTTCAGCGAGGAGGAAGGCGTAAAGTGAATAAC CGTTAATGGCATTGACGTTACTCGCAGAAGAAGCACCGGCTAACTCCGTGCCAGCAGCCGCGGTAATACGGAGGGTGCAAGCGTTAATCG GAATTACTGGGCGTAAAGCGCACGCAGGCGGTTTGTTAAGTCAGATGTGAAATCCCCGGGCTCAACCTGGGAACTGCATTG GAGACTGCAAGGCTAGAGTCTCGTAGAGGGGGGTAAGAATTCCAGGGTGTAGCGGGTGAAATGCGTAGAGATCTGGAGGAAT ACCGGTGGCGAAGGCGGCCCCCTGGGACGAAGACTGACGCTCAGGTGCGAAAGCGTGGGGAGCAAACAGGATTAGAT ACCCTGGTAGTCCACGCCGTAAACGATGTCGACTTGGAGGTTGTGCCCTTGAGGCGTGGCTTCCGGAGCTAACGCGTTAAGTCGAC CGCCTGGGGAGTACGGCCGCAAGGTTAAAACTCAAATGAATTGACGGGGGCCCGCACAAG CGGTGGAGCATGTGGTTTAATTCGATGCAACGCGAAGAACCTTACCTGGTCTTGACATCCAGCGATGTCGCAGAGATGA GAACGTGCCTTCGGGAACGCTGAGACAGGTGCTGCATGGCTGTCGTCAGCTCGTGTTGTGAAATGTTGGGTTAAGTCCC

FIG. 16AAE

| | | | |
|---|---|---|---|
| Clostridiales_sp_SM 4_1_NCBI_FP92906 0 | Clostridiales_sp_S M4_1 | FP929060 | SEQ ID NO: 142 | GCAACGAGGCGCAACCCTTATCCTTTGTTGCCAGCGGGTTAGGCGGTGAAGACTGGA GGAAGGTGGGGATGACGTCAAGTCATCATCATGCCCCTTACGACCAGGGCTACACACGTGCTACAATGGCATATACAAAGAG AAGCGACCTCG GACGAATTGACTGCAAGTGGCGGACGGGTGAGTAACGCGTGGGTAACCTGCCTCACACTGGGGGACAACAGCTGGAAAC GGCTGCTAATACCGCCATAAGCGCACACGCCTGGTGCGCATGAAGCAGTGTGAAAACTCCGGTGGTGTGAGATGGACCCGCGT CTGATTAGCTAGTTGGTAAGGTAAGGGCTTACCAAGGCGACGATCAGTAGCCGGCCTGAGAGGGTGAACGGCCACATT GGGACTGAGACACGGCCCAAACTCCTACGGGAGGCAGCAGTGGGGAATATTGCACAATGGGGGAAACCCTGATGCAG CGACGCCGCGTGAGTGAAGAAGTATTTCGGTATGTAAAGCTCTATCAGCAGGGAAGAAAATGACGGTACCTGACTAAGA AGCCCCGGCTAACTACGTGCCAGCAGCCGCGGTAATACGTAGGGGGCAAGCGTTATCCGGATTTACTGGGCGTAAAGG GAGCGTAGACGGGAAGCAAGTCTGAAGTGGAATTCCTAGTGTAGCGGTGAAATGCGTAGATATTAGGAGGAACACCAGT AGTGCTGAGAGGTGACGGCCGATGCCGAAAGCGTGGGGAGCAAACAGGATTAGATACCCTGGT AGCTTACTGGACGAAACTAGGTGTTGGTGAGCAAATAGTATTCCACCTGTAAGTCACGCCGT CGTAAACGATGAATACTAGGTGTTGGGGAGCAAAGCTCATCGGTGCCGTCAGCAATAAGTATTCCACCTGTTAAGCAT GTACGTTCGCAAGAACCTTACCAGCTCTGTGTTAATCAAGGAACTGAAGTAGGTATACGGGAGGAT GACGTGTGAAGTCGTGAAATGCAGGGCGCCGATTTGGCGCGCGTCAGGGATGACACCCATAAGCTTGAGCATGTTAATTCGATCGGATCAAGATTTTTAAT AAAAATGCCCGCCACAGCCCTTATGAACACAGGAAGAATGGAAGCTTCGCCGCCAACATTCGAATAGCGTAAGCTCT GCCCTAATGCAGGATGACACCCATAAGCTACGCCGCCATAGCTACGCCCGCCAAGATTCAATTCCTACCAGGAATATCAAAGTAT AAGCCCGGGCGAAGCCCCATAAGCGCCGTCGCCGATCTATCAGGGATCACAAGTGATGGCCCGCCGATCAGGTGCTGAATAACGTC TGCTCACCTTCCT |
| Clostridium_asparagi forme_DSM_15981_NCBI_ACCJ01000052 2 | Clostridium_aspar agiforme | ACCJ01000522 | SEQ ID NO: 143 | TGAGAGTTTGATCCTGGCTCAGGATGAACGCTGGCGGCGTGCCTAACACATGCAAGTCGAACGAAGCATTTTAGATGAA GTTTTCGGATGGAATCTGAGATGACTGAGTGGCGGACGGGTGAGTAACGCGTGAGGAACCTGCCTCACACTGGGGGAC AACAGTTAGAAATGACTGCTAATACCGCATAAGCGCACAGCCTCGCATGAGGAGGTCTGAAAACTCCGGTGGTGTGAG ATGGATCCGCGTCGATATGGGGACTTGAGAGCATAAGCCCGGAATATTGGACGGCAGCAGCGGATGATCAGTAGCCGACCTGAGAGGGTGAACCGCCACACTGGAACTGAGAGCACGGTCAGACTCCTAGGGGAGGCAGCAGTGGGGAATATTGCACAATGGGCGAAA GCCTGATGCAGCGACGCCGCGTGAGTGATGAAGGCCTTCGGGTCGTAAAGCTCTGTCCGCAGGGAACGATAATGACGGTA CCTGACTAAGAAGCCCCGGCTAAATACGTGCCAGCAGCCGCGGTAATACGTAGGGGGCAAGCGTTATCCGGATTTACT GGGTGTAAAGGGAGCGTAGGAGTGGCAGGCATGTCAAGTTGTCTAACTGCTAGTGTAACTGAAGATACCCTAAAGGGA TGTCAAGCTAGTGGCTTACTGACGTTGAACATCCAGAGAGCTAGCGCCGAAAGCAGATCCCTCGGCAGATGCATCGCAG GTGAAGCATCGGAAACGCCATGTCGCCAGCACCTGGGAAGCACCATAGATTGACATCGTCACAAATGACTTAAAAAGGGTAACCCCAGAGAGCTACCAGTAGGTCACACCAACCTGGAGCTGAACATTGCGCATAGCAGTCTACTCGGCCGAGTGCCAGGCAATGCAGCCGTTGTGGGGATGATCAAAAATAACGCCAGTTGACCAGTCCTCTAGGCGCAAGTCCAGGACTCCGGCCGGGTCCTTGGCGACTCCAGGCCGGGAGCGCCGGGCAATGCAAAGGAAAATGGTAGGGAAGCCAGGTCAAGGATGGCTCAAGGCCAATGCAAAGAGGCAAAAAGAAAACTGCAAATACTCCCAAGGCTTGCCAGAAGCCAATCGCGCCAGCGCCACCAGGAATAACGTCAAGGACAGCTTGCGCCGGCTGCCGGCCTCCGGCTAGTGATGCGGTCGAACCCCAGAGCGGAGGGCAGAAGTGCCAAGCGCGCGCCCGCCAGCAGCCGCGGTAATACGCGGAGGTAACCGCAAGATGTGGGACAAGTGGAGCCACCTAGGGCGCAAGGCCGTCAAGGAAGCCTGCCCTAGGCCTATAAAATACGTCAATGGGAATCGTAGGCCGTTAAATAGCCCTTCGAGAGGCAGTCCCCCCAGGATAAGCTAAGGCAGAGCATCGAAGAGAGGAGAATCCTAGCACCTGAAACGCCGGGGCAAGTCCAGGACTCCTCTCGGCGATCGGAAGGCAGTAACGTCAAGGAACACCAACCTGGAGCTGAACATAGCGCATAGCAGTCTACTCGAGCCGGGCGAAGGGACTCCCCCACAGAAATAACCCGCAAAGGGCCAACCATGCAAGAAGCGCCCTCCCTTTCT |
| Clostridium_bartlettii_DSM_16795_NCBI_ABEZ02000012 | Clostridium_bartlet tii | ABEZ02000012 | SEQ ID NO: 144 | AGAGTTTGATCCTGGCTCAGGATGAACGCTGGCTAACACATGCAAGTCGAGCGATCTCTTCGGAAGAGA GCGGCGGACGGGTGAGTAACGCGTGAGTAACCTGCCCTGTACACAACGGATAACATACCGAAAGGTATGCTAATACGGG ATAACATAAGAGAAATTCGCATGCTTTTCTTATCAAAGCTCCGGCGGTACAGGATGGACCCGCGTCTGATTAGCTAGTTGGT GAGGTAACGGCTCACCAAGGCGACGATCAGTAGCCGACCTGAGAGGGTGATCGGCCACATTGGAACTGAGACACGGTC CAAACTCCTACGGGAGGCAGCAGTGGGGAATATTGCACAATGGGGAAACCCTGATGCAGCAACGCCGCGTGAGTGATG AAGGCCTTCGGGTCGTAAAGCTCTGTCCTCAAGGAAGATAATGACGGTACTTGAGGAGGAAGCCCCGGCTAACTACGT |

FIG. 16AAF

| | | | | |
|---|---|---|---|---|
| | | | | GCCAGCAGCCGCGGTAATACGTAGGGGGCTAGCGTTATCCGGATTTACTGGGCGTAAAGGGTGCGTAGGCGGTCTTTTAAGTCAGGAGTGAAAGGCTACGGCTCAACCGTAGTAAGCTCTTGAAACTGGAGGACTTGAGTGCAGGAGAGGAGAGTGGAATTCCTAGTGTAGCGGTGAAATGCGTAGATATTAGGAGGAACACCAGTAGCGAAGGCGGCTCTCTGGACTGTAACTGACGCTGAGGCACGAAAGCGTGGGGAGCAAACAGGATTAGATACCCTGGTAGTCCACGCCGTAAACGATGAGTACTAGCTGTCGGAGGTTACCCCCTTCGGTGGCGCAGCTAACGCATTAAGTACTCCGCCTGGGGAGTACGCTCGCAAGAGTGAAACTCAAAGGAATTGACGGGGACCCGCACAAGTAGCGGAGCATGTGGTTTAATTCGAAGCAACGCGAAGAACCTTACCTAAGCTTGACATCCTTTTGACCGATGCCTAATCGCATCTTTCCCTTCGGGGACAGAAGTGACAGGTGGTGCATGGTTGTCGTCAGCTCGTGTCGTGAGATGTTGGGTTAAGTCCCGCAACGAGCGCAACCCTTGCCTTTAGTTGCCATCATTAAGTTGGGCACTCTAGAGGGACTGCCAGGGATAACCTGGAGGAAGGTGGGGATGACGTCAAATCATCATGCCCCTTATGCTTAGGGCTACACACGTGCTACAATGGGTGGTACAGAGGGCAGCGAAGTCGTGAGGCCAAGCTAATCCCTTAAAGCCATTCTCAGTTCGGATTGTAGGCTGAAACTCGCCTACATGAAGCTGGAGTTACTAGTAATCGCAGATCAGAATGCTGCGGTGAATGCGTTCCCGGGTCTTGTACACACCGCCCGTCACACCATGGGAGTTGGGGGCGCCCGAAGCCGGCTAGCTAACCTTTTGGAAGCGGTCGTCGAAGGTGAAACCAATAACTGGGGTGAAGTCGTAACAAGGTAGCCGTATCGGAAGGTGCGGCTGGATCACCT |
| Clostridium_bifermentans_ATCC_638_NCBI_AB075769 | Clostridium_bifermentans | AB075769 | SEQ ID NO: 145 | CATRGCTCAGGATGAACGCTGGCGGCGTGCCTAACACATGCAAGTCGAGCGATCTCTTCGGAGAGAGCGGCGGACGGGTGAGTAACGCGTGGGTAACCTGCCCTGTACACACGGATAACATACCGAAAGGTATACTAATACGGGATAACATATGAAAGTCGCATGGCTTTTGTATCAAAGCTCCGGCGGTACAGGATGGACCCGCGTCTGATTAGCTAGTTGGTAAGGTAATGGCTTACCAAGGCAACGATCAGTAGCCGACCTGAGAGGGTGATCGGCCACACTGGAACTGAGACACGGTCCAGACTCCTACGGGAGGCAGCAGTGGGGAATATTGCACAATGGGCGAAAGCCTGATGCAGCAACGCCGCGTGAGCGATGAAGGCCTTCGGGTCGTAAAGCTCTGTCCTCAAGGAAGATAATGACGGTACTTGAGGAGGAAGCCCCGGCTAACTACGTGCCAGCAGCCGCGGTAATATGTAGGGGGCTAGCGTTATCCGGAATTACTGGGCGTAAAGGGTGCGTAGGTGGTTTTTTAAGTCAGAAGTGAAAGGCTACGGCTCAACCGTAGTAAGCTTTTGAAACTAGAGAACTTGAGTGCAGGAGAGGAGAGTAGAATTCCTAGTGTAGCGGTGAAATGCGTAGATATTAGGAGGAATACCAGTAGCGAAGGCGGCTCTCTGGACTGTAACTGACACTGAGGCACGAAAGCGTGGGGAGCAAACAGGATTAGATACCCTGGTAGTCCACGCCGTAAACGATGAGTACTAGGTGTCGGGGGTTACCCCCCTCGGTGCCGCACTAACGCATTAAGTACTCCGCCTGGGAAGTACGCTCGCAAGAGTGAAACTCAAAGGAATTTDCGGGGACCCGCACAAGTAGCGGAGCATGTGGTTTAATTCGAAGCAACGCGAAGAACCTTACCTAAGCTTGACATCCCACTGACCTCTCCCTAATCGGAGATTTCCCTTCGGGGACAGTGGTGACAGGTGGTGCATGGTTGTCGTCAGCTCGTGTCGTGAGATGTTGGGTTAAGTCCCGCAACGAGCGCAACCCTTGCCTTTAGTTGCCAGCATTAAGTTGGGCACTCTAGAGGGACTGCCGAGGATAACTCGGAGGAAGGTGGGGATGACGTCAAATCATCATGCCCCTTATGCTTAGGGCTACACACGTGCTACAATGGGTGGTACAGAGGGTTGCCAAGCCGCGAGGTGGAGCTAATCCCTTAAAGCCATTCTCAGTTCGGATTGTAGGCTGAAACTCGCCTACATGAAGCTGGAGTTACTAGTAATCGCAGATCAGAATGCTGCGGTGAATGCGTTCCCGGGTCTTGTACACACCGCCCGTCACACCATGGAAGTTGGGGGCGCCCGAAGCCGGTTAGCTAACCTTTTAGGAAGCGGCCGTCGAAGGTGAACAAATGACTGGGGTGAAGTCGTAACAAGGTANCCGTATCGGAAGGTGCGGCBGGATCAA |
| Clostridium_bifermentans_DSM_10716_NCBI_X73437 | Clostridium_bifermentans | X73437 | SEQ ID NO: 146 | NNNNNNGAGAGTTTGATCCTGGCTCAGGATGAACGCTGGCGGCGTGCCTAACACATGCAAGTCGAGCGATCTCTTCGGAGAGAGCGGCGGACGGGTGAGTAACGCGTGGGTAACCTGCCCTGTACACACGGATAACTAACCGAAAGGTATACTAATACGGGATAACATATGAAAGTCGCATGGCTTTTGATATCAAAGCTCCGGCGGTACAGGATGGACCCGCGTGATTAGCTAGTTGGTAAGGTAATGGCTTACCAAGGCAACGATCAGTAGCCGACCTGAGAGGGTGATCGGCCACACTGGAACTGAGACACGGTCCAGACTCCTACGGGAGGCAGCAGTGGGGAATATTGCACAATGGGCGAAAGCCTGATGCAGCAACGCCGCGTGAGCGATGAAGGCCTTCGGGTCGTAAAGCTCTGTCCTCAAGGAAGATAATGACGGTACTTGAGGAGGAAGCCCCGGCTAACTACGTGCCAGCAGCCGCGGTAATACGTAGGGGGCTAGCGTTATCCGGAATTACTGGGCGTAAAGGGTGCGTAGGTGGTTTTTTAAGTCAGAAGTGAAAGGCTACGGCTCAACCGTAGTAAGCTTTTCAAACTAGAGAACTTGAGTGCAGGAGAGGAGAGTAGAATTCCTAGTGTAGCGGTGAAATGCGTAGATATTAGGAGGAATACCAGTAGCGAAGGCGGCTCTCTGGACTGTAACTGACACTGAGGCACGAAAGCGTGGGGAGCAAACAGGATTAGATACCCTGGTAGTCCACGCCGTAAACGATGAGTACTAGGTGTCGGGGTTACCCCCCTCGGTGCCGCAGCTAACGCATTAAGTACTCCGCCTGGGAAGTACGATCGCAAGATTAAAACTCAAAGGAATTGACGGGGACCCGCACAAGTAGCGGAGCATGTGGTTTAATTCGAAGCAACGCGAAGAACCTTACCTAAGCTTGACATCCCACTGACCTCTCCCTAATCGGAGATTTCCTTCGGGGACAGTGGTGACAGGTGGTGCATGGTTGTCGTCAGCTCGTGTCGTGAGATGTTGGGTTAAGTCCCGCAACGAGCGCAACCCTTGCCTTTAGTTGCCAGCATTAAGTTGGGCACTCTAGAGGGACTGCCGAGGATAACTCGGAGGAAGGTGGGGATGACGTCAAATCATCATGCCCCTTATGCTTAGGGCTACACACGTGCTACAATGGGTGGTACAGAGGGTTGCCAAGCCGCGAGGTGGAGCTAATCCCTTAAAGCCATTCTCAG |

FIG. 16AAG

| | | | |
|---|---|---|---|
| Clostridium_bitermen tans_JCM_1386_NC BI_AB618787 | Clostridium_biterm entans | AB618787 | SEQ ID NO: 147 | TTCGGATTGTAGGCT

FIG. 16AAH

| | | | |
|---|---|---|---|
| Clostridium_butyricu m_5521_NCBI_ABD T01000017 | Clostridium_butyric um | ABDT01000017 | SEQ ID NO. 150 | ACGGTACCTGAC

FIG. 16AAl

| | | | |
|---|---|---|---|
| Clostridium_coccoides_8F_NCBI_EF025906 | Clostridium_coccoides | EF025906 | SEQ ID NO: 152 | GGGAGGAAGGTGGGGATGACGTCAAATCATCATGCCCCTTATGTCTAGGGCTACACACGTGCTACAATGGTCGGTACAA TGAGATGCAACCTCGCGAGAGTGAGCAAACTCCAAAAGCCGATCTCAGTTCGGATTGTAGGCTGAAACTCGCCTACATG AAGCTGGAGTTGCTAGTAATCGCAGATCAGAATGCTGCGGTGAATACGTTCCCGGGCCTTGTACACACCGCCGTCACA CCATGAGAGTTGGCAATACCCAAAGTTCGTGAGCTAACCCGCAAGGAGGCAGCCGACCTAAGGTAGGGTCAGCGATTGGG GTGAAGTCGTAACAAGGTA |
| Clostridium_difficile_630_NC_009089 | Clostridium_difficile | NC_009089 | SEQ ID NO: 153 | TTTGAGTTTGATCCTGGCTCAGGATGAACGCTGGCGGCGTGCCTAACACATGCAAGTCGAGCGAAGCGACTTACTTCGGTAAA GTTCGCGGATTGAAGTCTTTGTGACTGAGTGAGCGAGCGGCGGGATGAACGCGTGGGTAACCTGCCTCATAGAGGGGAT AACAGTTAGAAATGACTGCTAATACCGCATAAGCGCACAGTAACCGCATGGTTACTGTGTGAAAAACTCCGGTGGTATGAG ATGGACCCGCGTCTGATTAGCTAGTTGGAGGGGTAACGGCCCACCAAGGCGACGATCAGTAGCCGACCTGAGAGGGT GAACGGCCACATTGGGACTGAGACACGGCCCAGACTCCTACGGGAGGCAGCAGTGGGGAATATTGCACAATGGGGGA AACCCTGATGGCAGCGACGCCGCGTGAGTGATGAAGGTCTTCGGATTGTAAAGCTCTGTCTTCAAGGAAGATAATGACGG TACTTGAGGAGGAAGCCCCGGCTAACTACGTGCCAGCAGCCGCGGTAATACGTAGGTGGCAAGCGTTGTCCGGATTTAC TGGGCGTAAAGGGTGCGTAGGCGGTTTTTTAAGTCAGGGGTGAAAGGCTACGGCTCAACCGTAGTACTGCCTTTGAAACTGG AAGACTTGAGTGCAGGAGAGGAGAGTGGAATTCCTAGTGTAGCGGTGAAATGCGTAGAGATTAGGAAGAACACCAGTGGCGAAGG CGACTCTCTGGACTGTAACTGACGCTGAGGCACGAAAGCGTGGGGAGCAAACAGGATTAGATACCCTGGTAGTCCACGC CGTAAACGATGAATACTAAGTGTTGGTAAATTGACCCATTAAGTGGCTAAGCGAAAGCAAGCAAGCGAAGCCGGT GTCAGCTCGTGTCGTGAGATGTTGGGTTAAGTCCCGCAACGAGCGCAACCCTTTGTCTTTAGTTGCCATCATTAAGTTGG GCACTCTAGAGAGACTGCCAGGGATAACCTGGAGAAGGTGGGGATGACGTCAAATCATCATGCCCCTTATGTCCTGGGC TACACACGTGCTACAATGGCATATACAATGGGAAGCGAAGGAGCGATCAGGTAATCGGAAGCAAGCTCAGAAAGTATTGTT CCCGGGATCTTGTACACACCGCCGTCACATCATGAAAAGTCAGTAACACCCGAAGCCGGTGGCCTAACCCTTGTGGAG GGAAGCCGTCGAAGGTGGGACAGATGATTGGGGTGAAGTCGTAACAAGGTAGCCGTATCGGAAGGTGCGGCTGGATCCAC CTCCTTTCT |
| Clostridium_difficile_ATCC_43255_NCBI_ABKJ02000039 | Clostridium_difficile | ABKJ02000039 | SEQ ID NO: 154 | AGAGTTTGATCCTGGCTCAGGATGAACGCTGGCGGCGTGCCTAACACATGCAAGTTGAGCGACTGATTTACTTCGGTAAAGAG CGGCAGACGGGTGAGTAACGCGTAACCTGCCTACCCTGTACACACGGATAACATACCGAAAGGTATGCTAATACGGGA TAATATATTTGAGAGGCATCTCTTGAATATCAAAGGTTAGCCAGTAGCCGATGATGACCCGCGTCTGATTAGCTAGTTGGTA |

FIG. 16AAJ

| | | | |
|---|---|---|---|
| Clostridium_difficile_ATCC_9689_NCBI_AB075770 | Clostridium_difficile | AB075770 | SEQ ID NO: 155 | AGGTAACGGCCTTACCAAGGGCGACGATCAGTAGCCGACCTGAGAGGGTGATCGGCCACATTGGAACTGAGACACGGTCC<br>AAACTCCTACGGGAGGCAGCAGTAGGGAATATTGCACAATGGGCGAAAGCCTGATGCAGCGACGCCGCGTGAGTGATG<br>AAGGCCTTCGGGTCGTAAAACTCTGTCCTCAAGGAAGATAATGACGGTACTTGAGGAGGAAGCCCCGGCTAACTACGTG<br>CCAGCAGCCGCGGTAATACGTAGGGGGCTAGCGTTATCCGGATTTACTGGGCGTAAAGGGTGCGTAGGCGGTCTTTCA<br>AGTCAGGAGTGAAATGTAGCGGCTCAACCGTAGTAAGCTCTTGAAATGGAGAGCTTGAGTGCAGGAGAGGAGAGTGG<br>AATTCCTAGTGTAGCGGTGAAATGCGTAGATATTAGGAGGAACACCAGTGGCGAAGGCGGCTCTCTGGACTGTAACTGA<br>CGCTGAGGCACGAAAGCGTGGGGAGCAAACAGGATTAGATACCCTGGTAGTCCACGCCGTAAACGATGATGACTAGGT<br>GTCGGGGGTTACCCCCTTCGGTGCCGCAGCTAACGCAAGTACTGCCGCCTGGGGAGTACGGTCGCAAGATTGAAAC<br>TCAAAGGAATTGACGGGGACCCGCACAAGCAGCGGAGCATGTGGTTTAATTCGAAGCAACGCGAAGAACCTTACCTAAG<br>CTTGACATCCCAATGACGTGTCTGTAATGGACATTGGTGACAGGTGGTGCATGGTTGTCGTC<br>GTGAGATGTTGGGTTAAGTCCCGCAACGAGCGCAACCCTTGTCTTTAGTTGCCATCATTAAGTTGGGCA<br>CTCTAGAGAGACTGCCGTCGACAAGGAGGAAGGTGGGGATGACGTCAAATCATCATGCCCCTTATGTCTAGGGCTA<br>CACACGTGCTACAATGGCGTATACAAAGGGTTGCCAACTCGCGAGAGGGAGCTAATCCCTAAAGTACTCTCAGTTCG<br>GATTGTAGGCTGCAACTCGCCTACATGAAGCTGGAGTTGCTAGTAATCGCAGATCAGAATGCTGCGGTGAATGCGTTCC<br>CGGGTCTTGTACACACCGCCCGTCACACCATGGGAGTTGGGAATGCCCGAAGCCGGTGGCCTAACCTTTTGGAGAAGT<br>CGAAGGTGGAATCAATAACTGGGGTGAAGTAGCGTAACAAGGTGAAGGTGACGGTCTG |
| Clostridium_difficile_B11_NCBI_FN66941 | Clostridium_difficile | FN668941 | SEQ ID NO: 156 | ATCATKGCTCABGATGAACGCTGGCGGCGTGCCTAACACATGCAAGTTGAGCGATTNACTTCGGTAAAGAGCGGCGGAC<br>GGGTGAGTAACGCGTGGGTAATACCTCACCCTGTACACAGGATAACATACCGAAAGGTATGCTAATACGGCATATATATT<br>GAGAGGCATCTCTTGAATATCAAAGGTGAGCCAGTAGAAAGCTGGGCAGCATGGAATAGAGACTGCGTCTGATTAGCTA<br>CTTACCAAGGCGACGATCAGTAGCCGACCTGAGAGGGTGATCGGCCACATTGGAACTGAGACACGGTCCAAACTCTAC<br>GGGAGGCAGCAGTGGGGAATATTGCACAATGGGCGAAAGCCTGATGCAGCAACGCCGCGTGAGTGATGACGGCCCTTC<br>GGGTCGTAAACTCTGTCTCAAGGAAGATAATGACGGTACTTGAGGAGGAAGCCCCGGCTAACTACGTGCCANCAGC<br>CGCGGTAATACGTAGGGGGCTAGCGTTATCCGGATTTACTGGGCGTAAAGGGTGCGTAGGCGGTCTTTTCAAGTCAGGA<br>GTGAAAGTCAGCGGCTCAACCGCTGATGCGTAGATATTAGGAGGAACACCAGTGGCAAGGCGGCTGTCGACGGGGAA<br>GCACAAAGTGCGTGGGGAGCAAACAGGATTAGATACCCTGGTAGTCCACGCCGTAAACGATGATTACTATGAAACTCAAA<br>GTTACCCCCTTCGGTGCCGCACAAGTAGCGGAGCATGCGGTTAATTCAAGCAATGACTTTAGGTGCCTAGAGGAAT<br>TGACAACATCTGGGTTAAGTCCCGCAACGAGCGCAACCCTTGTCTTTAGTTGCCATCATCATGGAGCTACTCCAGTGCTGGC<br>CAATGACATGTGCTCGCAGGGCGTGGCTCAGCGGATCCACAGTGTCCACATCAAGCAGTCAGTCAGTGCTACGTGTGTC<br>GTGAGATGTTGGGTTACAAGAGGGTGCCAGGACCAAGTAGACAAGAGTACCAACATGCCGGTCACGTGTCAGAGACACAGCATGG<br>TGAAACCGCCGCGATATGAAGCGAGATTAACTTAGCAGGGCCTAGCAGGAGTACGTGCGACTGCGCTTCCGGGTCTTTA<br>CACACCGCCCGTCACACCATGGGAGTTGGCAATGCGGAAGCCAATCAAGTAGTCTGCCAACGCCGGGGAATCTACGTGGCT<br>GGAATCAATAACTGGGGTNAAACTGACAAAGGTAAACGAAACGGTAACCGTATCGGAAGT |
| | | | | AGAGTTTGATCCTGGCTCAGGATGAACGCTGGCGGCGTGCCTAACACATGCAAGTTGAGCGATTTACTTCGGTAAAGAG<br>CGGCGGACGGGTGAGTAACGCGTGGGTAACCTACGCCCTGTACACAGGATAACATACCGAAAGGTATGCTAATACGGA<br>TAATATATTTGAGAGGCATCTCTTGAATATCAAAGGTGAGCCAGTAGCTACATAAAGGTATGCGAATCATGGAATAGAGTAGTTGGTA<br>AGGTAACGGCCTTACCAAGGCGACGATCAGTAGCCGACCTGAGAGGGTGATCGGCCACATTGGAACTGAGACACGGTG<br>AAACTCCTACGGGAGGCAGCAGTGGGGAATATTGCACAATGGGCGAAAGCCTGATGCAGCAACGCCGCGTGAGTGATG<br>AAGGCCTTCGGGTCGTAAACTCTGTCCTCAAGGAAGATAATGACGGTACTTGAGGAGGAAGCCCCGGCTAACTACGTG<br>CCAGCAGCCGCGGTAATACGTAGGGGGCTAGCGTTATCCGGATTTACTGGGCGTAAAGGGTGCGTAGGCGGTCTTTCA<br>AGTCAGGAGTGAAATGTAGCGGCTAACCGCTACAGCGTAGATATTGGGAGGAACACCAGTGGCGAAGGCGGCTGTCTGG<br>CGGAGGATTGACGGGCCCGCACAAGCGGCGGAGCATGTGGTTTAATTCGAAGCAACGCGAAGAACCTTACCTGA<br>GAAAGGAATTTGACGGGGTCCCGCACAAGCAGCGGAGCATGTGGTTTAATTCGAAGCAACGCGAAGAACCTTACCTGA<br>CTTGACATCCCAATGACATGACTAGGTAATCGATTAAAGTTAAGTCGCCAACGCCAAGGTGGTGCATGGTTGTCGTCG |

FIG. 16AAK

| | | | |
|---|---|---|---|
| Clostridium_difficile_B19_NCBI_FN66894 4 | Clostridium_difficile | FN668944 | SEQ ID NO: 157 | AGCTCGTGTCGTGAGATGTTGGGTTAAGTCCCGCAACGAGCGCAACCCTTGTCTTTAGTTGCCATCATTAAGTTGGGCA<br>CTCTAGAGACTGCCAGGGATAACCTGGAGGAAGGTGGGGATGACGTCAAATCATCATGCCCCTTATGCCTTAGGGCTA<br>CACACGTGCTACAAATGGGTAGTACAGAGGGTTGCCAACCCGTGAGGGGGAGCTAATCCCATAAAGCTACTCTCAGTTCG<br>GATTGTAGGCTGCAACTCGCCTACATGAAGCTGGAGTTGCTAGTAATCGCAGATCGCAGAATGCTGCGGTGAATGCGTTCC<br>CGGGTCTTGTACACACCGCCCGTCACACCATGGGAGTTGGGAATGCCCGAAGTCAGTGAGCTAACCGCAAGGAGGCA<br>CGCCGAAGGTGGAATCAATAACTGGGGTGAAGTCGTAACAAGGTAGCCGTG<br>AGAGTTTGATCCTGGCTCAGGATGAACGCTGGCGGCGTGCCTAACACATGCAAGTCGAGCGATTTACTTCGGTAAAGAG<br>CGGCGGACGGGTGAGTAACGCGTGGGTAACCTGCCCTTGTATACGGGATAACATACCGAAAGGTATGCTAATACGGGA<br>TAATATATTGAGAGCATCTCTTGAATATCAAAGATTTATCGCTGAGAGATGGGCCCGCGTCTGATTAGCTAGTTGGTA<br>AGGTAACGGCTTACCAAGGCGACGATCAGTAGCCGACCTGAGAGGGTGATCGGCCACATTGGGACTGAGACACGGTCC<br>AAACTCCTACGGGAGGCAGCAGTGGGGAATATTGCACAATGGGCGAAAGCCTGATGCAGCGACGCCGCGTGAGTGATG<br>AAGGCCTTCGGGTCGTAAAGCTCTGTCCTCAAGGAAGATAATGACGGTACTTGAGGAGGAAGCCCCGGCTAACTACGTG<br>CCAGCAGCCGCGGTAATACGTAGGGGGCTAAGCGTTATCCGGATTTACTGGGCGTAAAGGGAGCGCAGGCGGTCTTTCA<br>AGTCAGGAGTGAAATGCTACGGCTCAACCGTAGATAGTGCTGAAACTGCGAAGCTAGAGTTATGGAGGAGAGTGG<br>AATTCCTAGTGTAGCGGTGAAATGCGTAGATATACTAGGAGGAACACCAGTGGCGAAGGCGGCTCTCTGGACTGTAACTGA<br>CGCTGAGGCTACGAAAGCGTGGGGAGCAAACAGGATTAGATACCCTGGTAGTCCACGCTGTAAACGATGAGTACTAGGT<br>GTCGGGGGTTACCTTTCGGTGCCGACGCAGCTAACGCATTAAGTACTCCGCCTGGGGAGTACGCTCGCAAGAGTGAAAC<br>TCAAAGGAATTGACGGGGACCCCGCACAAGCAGCGGAGCATGTGGTTTAATTCGAAGCAACGCGAAGAACCTTACCTAAG<br>CTTGACATCCCAATGACGTCGTAGAGATATGGAAGTTCCTTCGGGACAGTTGGTGACAGGTGGTGCATGGTTGTCGTC<br>AGCTCGTGTCGTGAGATGTTGGGTTAAGTCCCGCAACGAGCGCAACCCTTATGCTTAGTTGCCAGCATTAAGTTGGGCA<br>CTCTAAGCGAGACTGCCGGGGATAACCCGGAGGAAGGTGGGGATGACGTCAAATCATCATGCCCCTTATGTCTAGGGCTA<br>CACACGTGCTACAATGGTAGGGTACAATGAGAAGCAATATCGTAGACACAAGCCCCGAAGAAGAAAC<br>GATTAGGCTGCAACTCGCCTACATGAAGCTGGAGTTACTAGTAATCGCAGATCAGCATGCTGCGGTGAATACGTTCCC<br>GGGTCTTGTACACACCGCCCGTCACACCATGGAGTTGGGAATACCCGAAGCTGGTGCGCTAACCTTTGGGAGAAGT<br>TGTCTAAGGTAAAACTGGTGATTGGGGACGAAGTCGTAACAAGGTAGCCGTAGGGGAACCTGCGGCTG |
| Clostridium_difficile_CD196_NC_013315 | Clostridium_difficile | NC_013315 | SEQ ID NO: 158 | GAACATTGAAAATTAAACAGTAGGTTAATTTATATTAAGAAACAAACCAGATATTTGATAACAATAGTATCTG<br>AGCCTGATAAACTTTATTTGAGAGTTTGATCCTGGCTCAGGATGAACGCTGGCGGCGTGCCTAACACATGCAAGTTGAG<br>CGATTTACTTCGAGTAAATCGGGATAATACGGGATAATATATCAAAGGATACATACCCGAAAGGTATAAATCAAGTTGAG<br>AAGGTATGCTAATACGGGATAATATATTGAGAGGCATCTCTTAAATATCAAAGGTAGCCGACTGAGAGGATGGACCCGCG<br>TCTGATTAGCTAGTTGGTGTAAGGTAACGGCTTACCAAGGCGATCAGTAGCCGACCTGAGAGGGTGATCGGCCACATT<br>GGAACTGAGACACGGTCCAAACTCCTACGGGAGGCAGCAGTGGGGAATATTGCACAATGGGCGAAAGCCTGATGCAGC<br>AACGCCGCGTGAGTGATGAAGGCCTTCGGGTCGTAAAGCTCTGTCCTCAAGGAAGATAATGACGGTACTTGAGGAGGAA<br>GCCCCGGCTAACTACGTGCCAGCAGCCGCGGTAAATACGTAGGGGGCTAGCGTTATCCGGATTTACTGGGCGTAAAGGG<br>TGCGTAGGCGGTCTTTCAAGTCAGGAGTGAAATGCCTAGATATTAGGAGGAACACCAGTGGCGAAGGCGGCTGAGT<br>TCTCTGGACTGTAACTGACGCTGAGGCTAGCAAACAGGATTAGATACCCTGGTAGTCCACGCTGTAAACGCGAACG<br>AACGATGAGTACTAGGTGTCGGGGGTTACCCCCTCGGTGCCGCAGCTAACGCAAATTCCCTTGGGAGTACGCTCGCAAGAGTAC<br>GCTCGCAAGAACCTAAAGCCGAAAACCGAAAAACTCAAAGGAATTGACGGGGGACCCGCACAAGCAGCGGAGCATGTGGTT<br>CGAAGAACCTTACCTAAGCTTGACATCCTTCTGACCGATATGGAAAGTAACCCTTGTCTTCTTGCC<br>CATCATTAAGTGCTTAGGCTACACACGTGCTACACAAAGGATAGTACAATGAGAAGCTAAGCTAATCATCGAGCC<br>CCTTATGCTTAGGGCTACACACGTGCTACAATGGATAGTACAGGGAAGGAAGCTAAATCAAATCATCCTTA<br>AAGCTACTCTCAGTTCGGATTGTAGGCTGCACACGATGGAAGCTGGAATCGCTAGTAATCGCAGATCAGAATGCT<br>AACCTTTGAAAGAGGATAAGCCGTAACAAGGTAGCCGTAGGGGAACCTGCGGCTG<br>GGCTGGATCACCTCCTTTCTAAGGAGAAGTCGTAACAAGGTAGCCGTAGGGGAACCTGCGGCTG |

FIG. 16AAL

| | | | |
|---|---|---|---|
| Clostridium_difficile_CF5_NCBI_FN6656 52 | Clostridium_difficile | FN665652 | SEQ ID NO: 159 | AGAGTTTGATCCTGGCTCAGGATGAACGCTGGCGGCGTGCCTAACACATGCAAGTTGAGCGATTTACTTCGGTAAAGAG<br>CGGCGGACGGGTAGTAACGCGTGAGGAACCTGCCTCTGTACACGGGATAATAGCCGGAAAGGTATGCTAATACCGGA<br>TAATATATTGAGAGGCATCTCTTGAATATCAAAGGTGAGCCAGTAGCCGGTCTGATTAGTTGGTA<br>AGGTAACGGCTTACCAAGGCGACGATCAGTAGCCGACTGAGAGGTGATCGGCCACATTGGGACTGAGACACGGTCC<br>AAACTCCTACGGGAGGCAGCAGTCTGGGAATATTGCACAATGGGCGAAAGCCTGATGCAGCAACGCCGCGTGAGTGATG<br>AAGGCCTTCGGGTCGTAAAGCTCTGTCCTCAAGGAAGATAATGACGGTACTTGAGGAGGAAGCCCCGGCTAGGGTGTCA<br>CCGCAGCGCCGGTGAATACGTTCCCGGGTCTTGTACACACCGCCCGTCACACCATGAGAGTTGGCAATACCCGAAGTCG<br>AGTTCAGGAGTACGGCTGAAATGCGTAGATATTAGGAGGAACAGGATTAGATACCCTGGTAGTCCACGCCGTAAACGATGA<br>GTGCTAGGTGTAGCGGTGAAATGCGTAGATATTAGGAGGAACACCAGTTGCGAAGGCGGCTCACTGGACCGTATACTGACA<br>CGTGAAGCACGAAAGCGTGGGTACCGAGGCAAGAGAGAATTAGATACCCTGGTAGTCCCACGCCGTAAACGATGAGTACTAGGT<br>GTCGGGGGGTTACCCCTTCGGTGCCGCAGCTAACGCAATAAGTACTCCGCCTGGGGAGTACGGTCGCAAGGCTGAAACC<br>TCAAAGGAATTGACGGGGACCCGCACAAGCGGTGGAGCATGTGGTTTAATTCGAAGCAACGCGAAGAACCTTACCTAAG<br>CTTGACATCCCAATGACATCCTCCTTAATCGGAGACATTTCCTTCGGGGACAGATTGGTGACAGGTGGTGCATGGTTGTCGT<br>CAGCTCGTGTCGTGAGATGTTGGGTTAAGTCCCGCAACGAGCGCAACCCTTGTCTTTAGTTGCCATCATTAAGTTGGGCA<br>CTCTAGAGAGACTGCCAGGGATAACCTGGAGGAAGGTGGGGATGACGTCAAATCATCATGCCCCTTATGCTACCTCAGTTCG<br>CACACGTGCTACAATGGGCAGTACAGAGGGTTGCCAAGCCGTGAGGTGGAGCTAATCCCATAAAGCTGCTCTCAGTTCG<br>GATTGTAGGCTGAAACTCGCCTACATGAAGCTGGAGTTACTAGTAATCGCAGATCAGAATGCTGCGGTGAATGCGTTCC<br>CGGGTCTTGTACACACCGCCCGTCACACCATGAGAGTCGGCAATACCCGAAGTCGGTGGCCTAACCCTTTGGAAGAGC<br>CGTCGAAGGTGGAATCAATAACTGGGGTGAAGTCGTAACAAGGTAGCCGTATCGGAAGGTGCGGCTG | 
| Clostridium_difficile_M120_NCBI_FN665 653 | Clostridium_difficile | FN665653 | SEQ ID NO: 160 | AGAGTTTGATCCTGGCTCAGGATGAACGCTGGCGGCGTGCCTAACACATGCAAGTTGAGCGATTTACTTCGGTAAAGAG<br>CGGCGGACGGGTGAGTAACGCGTGAGGAACCTACCTCTGTACACGGGATAATACCGGATAATACCGGATAGTTGGTA<br>TAACATATTTGAGAGGCATCTCTTAAATATCAAAGGTGAGCCAGTAGCCGGTCTGATTAGCTAGTTGGTGTC<br>AGGTAACGGCTTACCAAGGCAGCGATCAGTAGCCGACCTGAGAGGGTGATCGGCCACATTGGGACTGAGACACGGTCC<br>AAACTCCTACGGGAGGCAGCAGTGGGAATATTGCACAATGGGCGAAAGCCTGATGCAGCAACGCCGCGTGAGTGATG<br>AAGGCCTTCGGGTCGTAAAGCTCTGTCCTCAAGGAAGATAATGACGGTACTTGAGGAGGAAGCCCCGGCTAACTACGTG<br>CCAGCAGCCGCGGTAATACGTAGGGGGCAAGCGTTGTCCGGAATTTATTGGGCGTAAAGGGTGCGTAGGCGGAGAGTGG<br>AATTCCCTAGTGTAGCGGTGAAATGCGTAGATATTAGGAGGAACACCAGTTGCGAAGGCGGCTCTCTGGACTGTAACTGA<br>CGCTGAGGCACGAAAGCGTGGGGAGCAAACAGGATTAGATACCCTGGTAGTCCACGCCGTAAACGATGATAACCTTACCTAAG<br>GTCGGGGGTTACCCGTTAGGGTGCCGCCTAACGCGCACAAGCGTGAGCAACGGTGGAGGAGGCATGTGGTTTAATTCGAAGCAACGCGAAGAACCTTACCTAAG<br>CTTGACATCCCAATGACATCCTCCTTAATCGGAGATATCCCTTTCCCGGGACAGATTGGTGACAGGTGGTGCATGGTTGTCGT<br>CAGCTCGTGTCGTGAGATGTTGGGTTAAGTCCCGCAACGAGCGCAACCCTTGTCTTTAGTTACCATCATCATGCCCCTTATGCTACTCTCAGTTCGG<br>CTCTAGAGAGACTGCCAGGGATAACCTGGAGGAAGGTGGGGATGACGTCAAATCATCATGCCCCTTATGCTACTCTCAGTTCG<br>CACACGTGCTACAATGGGCAGTACACACACGGGTTGCCAAGCCGTGAGGTGGAGCTAATCCCATAAAGCTGCTCTCAGTTCGG<br>GATTGTAGGCTGAAACTCGCCTACATGAAGCTGGAGTTACTAGTAATCGCAGATCAGAATGCTGCGGTGAATGCGTTCC<br>CGGGTCTTGTACACACCGCCCGTCACACCATGAGAGTCGGCAATACCCGAAGTCGGTGGCCTAACCTTTGAAGAAGGT<br>CGTCGAAGGTGGAATCAATAACTGGGGTGAAGTCGTAACAAGGTAGCCGTATCGGAAGGTGCGGCTG |
| Clostridium_difficile_M68_NCBI_FN6683 75 | Clostridium_difficile | FN668375 | SEQ ID NO: 161 | AGAGTTTGATCCTGGCTCAGGATGAACGCTGGCGGCGTGCCTAACACATGCAAGTTGAGCGATTTACTTCGGTAAAGAG<br>CGGCGGACGGGTGAGTAACGCGTGGGTAACCTGCCTAACACATCAGGATAACATACCGAAAGGTATGCTAATACGGGGA<br>TAATATATTGAGAGGCATCTCTTGAATATCAAGGTGAGCCAGTAGCCGGTCTGATTAGCTAGTTGGTA<br>AGGTAACGGCTTACCAAGGCGACGATCAGTAGCCGACCTGAGAGGGTGATCGGCCACATTGGGACTGAGACACGGTCC<br>AAACTCCTACGGGAGGCAGCAGTGGGAATATTGCACAATGGGCGAAAGCCTGATGCAGCAACGCCGCGTGAGTGATG<br>AAGGCCTTCGGGTCGTAAAGCTCTGTCCTCAAGGAAGATAATGACGGTACTTGAGGAGGAAGCCCCGGCTAACTACGTG<br>CCAGCAGCCGCGGTAATACGTAGGGGGCAAGCGTTGTCCGGAATTTATTGGGCGTAAAGGGAGCGTAGGCGGAGAGTGG<br>AATTCCTAGTGTAGCGGTGAAATGCGTAGATATTAGGAGGAACACCAGTGGCGAAGGCGGCTCTCTGGACTGTAACTGA<br>CGCTGAGGCACGAAAGCGTGGGGAGCAAACAGGATTAGATACCCTGGTAGTCCACGCCGTAAACGATGAGTACTAGGT |

FIG. 16AAM

| | | | |
|---|---|---|---|
| Clostridium_difficile_NAP07_NCBI_ADV M01000095 | Clostridium_difficile | ADVM01000009 5 | SEQ ID NO: 162 | GTCGGGGGGTTACCCCCTTCGGTTGCCGCAGCTAACGCATTAAGTACTCCGCCTGGGAAGTATGCGTCGCAAGAGTGAAAC TCAAAGGAATTGACGGGGACCCGCACAAGCAGTGGAGCACATGTGGTTTAATTCGAAGCAACGCGAAGAACCTTACCTAAG CTTGACATCCTCCAATAGACATCTCCTTAATCGGGAGAGTTCCTTCGGGACACATTGGTGACGGTGGTGCATGGTTGTCGTC AGCTCGTGTCGTGAGATGTTGGGTTAAGTCCGCAACGAGCGCAACCCTTGTCTTTAGTTGCCATCATTAAGTTGGGCA CTCTAGAGAGACTGCCAGGGATAACCTGGAGGAAGGTGGGGATGACGTCAAATCATCATGCCCCTTATGCCTAGGGCTA CAACACGCTACAATGGGCGTTACAATGGGTTGCCAAGCGTAATGGAGACGTTACTGAGGAAGCAAGACTACGTCAATCCG GATTCTAGGCTGAAACTCGTCTACATGAAGCTGGAATCGCTAGTAATCGCAGATCAGAATGCTGCGGTGAATGCGTTCC CGGGTCTTGTACACACCGCCCGTCACACCATGGGAGTTGGTAATACCCGAAGCCAGTGAGCTAACCGTAAGGAGGGA CGTCGAAGGTGGAATCAATGACTGGGGTGAAGTCGTAACAAGGTAGCCGTATCGGAAGGTGCGGCTG |
| Clostridium_difficile_NAP08_NCBI_ADNX 01000106 | Clostridium_difficile | ADNX01000010 6 | SEQ ID NO: 163 | AGAGTTTGATCCTGGCTCAGGATGAACGCTGGCGGCGTGCCTAACACATGCAAGTTGAGCGATTTACTTCGGTAAAGAGA CGGCGGACGGGTGAGTAACGCGTGGGTAACCTACCCTCTACACGGGGATAACGCTAATAGAGCAAAGGTATGCTA ATACATATTTGAGAGAAGATCATCTCTTGATATCAAAGGTGAGCCAGTACAGATGAGCCGCACATTAAGTAGCT AGGTAAGGCATTACCAAGGCGACGATAGCCAGCTGAGATCCAGCGATCAGTAGCCGGCCTGAGAGGGTGACCGGCCACATTGGAACTGAGA CACGGTCCAAACTCCTACGGGAGGCAGCAGTGGGGAATATTGCACATGGGCGAAAGCCTGATGCAGCAACGCCGCGT GAGTGATGAAGGCCTTCGGGTCGTAAAACTCTGTCTCAAGGGACGATAATGACGGTACTTGAGGAGGAAGCCCCGGCTA ACTACGTGCCAGCAGCCGCGGTAATACGTAGGGGGGGCAAGCGTTGTCCGGATTTACTGGGCGTAAAGGGTGCGTAGGCG GTCTTTCAAGTCAGGGGTGAAAGGCTACGGCTCAACCGTAGTAAGCCCTTGAAACCACCAGTTGGAGACTTGAGGAGG AGAGTGGAATTCCTAGTGTAGCGGTGAAATGCGTAGAGATATTAGGAGGAACACACCCGTGGCGAAGGCGCTCTCTGGACTG TAACTGACGCTGAGGAGCGCGAAACCGTGGGGAGCAAACAGGATTAGATACCCTGGTAGTCCACGCCGTAAACGATGAGTA CTAGGTGTGCGGGGGTTACCCGCTCGTGTCGCACGCCAACGCATTAAGTACTCCGCCTGGGGAGTACGGCCACAAGCTA AAACTCAAAGGAATTGACGGGGACCCGCACAAGCAGCGGAGCATGTGGTTTAATTCGAAGCAACGCGAAGAACCTTACCTA GGGCTTGACATCCTCTGACAACCCTAGAGATAGGGCTTCCCTTCGGGGCAGAGGAGACAGGTGGTGCATGGTTGT CGTCAGCTCGTGTCGTGAGATGTTGGGTTAAGTCCGCAACGAGCGCAACCCTTGTCTTTAGTTGCCATCATTAAGTTGGGCA CTCTAGAGAGACTGCCAGGGATAACCTGGAGGAAGGTGGGGATGACGTCAAATCATCATGCCCCCTTATGCTTAGGGCT T |
| Clostridium_difficile_QCD_23m63_NCBI_ABKL02000056 | Clostridium_difficile | ABKL02000056 | SEQ ID NO: 164 | GGGCGGACGGGTGAGTAACGCGTGAGTAACCTACCCGTGTACACGGGATAACATACCGAAAGGTATGCTAATACGGAT AACATATTTGAAGAGAAGATCATCTTGAATATCAAAGGTGAGCCAGTACAGATGAGCCGCGTCGTCATTAGGATTGGTAA GGTAACGGCTTACCAAGGCGACGATACGTAGCCGACCTGAGAGGGTGATCGGCCACATTGGAACTGAGACACGGTCCA |

FIG. 16AAN

| | | | |
|---|---|---|---|
| Clostridium_difficile_QCD_63q42_NCBI_ABHD02000039 | Clostridium_difficile | ABHD02000003 9 | SEQ ID NO: 165 | AACTCCTACGGGAGGCAGCAGTGGGGAATATTGCACAATGGGCGAAAGCCTGATGCAGCAACGCCGCGTGAGTGATGA AGGCCTTCGGGTCGTAAAACTCTGTCCTCAAGGAAGATAATGACGACGTACGAGGAAGAAGCCCCGGCTAACTACGTGC CAGCAGCCGCGGTAATACGTAGGGGGCTAGCGTTATCCGGATTTACTGGGCGTAAAGGGTGCGTAGGCGGTCTTTCAA GTCAGGAGTGAAAGGCTACGGCTCAACCGTAGTAATGCTCTTGAAACTGGAAGACTTGAGTGCAGAAGAGGAGAGTGGA ATTCCTAGTGTAGCGGTGAAATGCGTAGAGATTAGGAAGAACACCAGTGGCGAAGGCGGCTCTCTGGACTGTAACTGAC GCTGAGGCACGAAAGCGTGGGGAGCAAACAGGATTAGATACCCTGGTAGTCCACGCCGTAAACGATGAATACTAGGTG TCGGGGGGTTACCCCCTCGGTGCCGCAGCTAACGCAATAAGTATTCCGCCTGGGGAGTACGCACGCAAGTGTGAAACT CAAAGGAATTGACGGGGACCCGCACAAGCGGTGGAGCATGTGGTTTAATTCGAAGCAACGCGAAGAACCTTACCTAGC TTGACATCCCAATGACATCTCCTTAATCGGAGATTGGGACATTGTTGACAAGGTGTGCATGGTTGTCGTCA GCTCGTGTCGTGAGATGTTGGGTTAAGTCCCGCAACGAGCGCAACCCTTGTCTTTAGTTGCCATCATTAAGTTGGGCAC TCTAGAGAGACTGCCAGGGATAACCTGGAGGAAGGTGGGGATGACGTCAAATCATCATGCCCCTTAATGACCTGGGCTAC ACACGTACATACAAGGGCTACACACGTGCTACAATGGCGTAGAACTGGGAGGGCGCGAAGTCGTGAAGCTGAGCGAAT CCCGAAAGCCGATCTCAGTTCAGATTGTAGGCTGCAACTCGCCTACATGAAGTCGGAATCGCTAGTAATCGCGGATCAGC ATGCCGCGGTGAATACGTTCCCGGGCCTTGTACACACCGCCCGTCACACCACGAGAGTTGGTAATACCCGAAGCCGGTGG CCTAACCTTTTGGAGGGAGCCGTCTAAGGTGGGACAGATGATTGGGGTGAAGTCGTAACAAGGTAGCCGTATCGGAAGG TGCGGCTGGATCACCTCCTTTCT |
| Clostridium_difficile_QCD_66c26_NCBI_ABFD02000003 | Clostridium_difficile | ABFD02000003 | SEQ ID NO: 166 | TTGAGAGTTTGATCCTGGCTCAGGATGAACGCTGGCGGCGTGCCTAACACATGCAAGTTGAGCGAAGTTACTTCGGTAAA GAGCGGCGGACGGGTGAGTAACGCGTGGGTAACCTACCCTGTACACGGGGATAACTGTTAGAAATGACAGCTAATACCGCATAAGACG GGATAATATTTGAGAGGCATCTCTTAAATATCAAGATGAGCCGATATACAGGATGACAGGAGTACAGGCTACAGCGAGAACCGTGAGGGAGAGGCTACGGGTTG AACCGTGAGGTTGGTTTACCGGTGTAGGTCTACAAGACCAAGCTCAAGCCAGCCTCTAGACTCCTCGCAAAGCTCTAGGGGGAGCTACGACTCCGATGGGCGAGTCCAGAGCCAGTCGCGGTGTGAATGACGGAATGCCGAGATCGAGAGCTTGAGTTAACGGAGACGAGAAAACTTCGGGTCGGGAGAAAAAGCTGGTAATGGTGATGGAAAATTAGGGCGAGAAACCTAAACAAGAGAGAACCTAAAGGCTTGGTCAATGGGAGCCAGAGACCAAGTCAGCAGTCGGCTCAATGGCTAATAACTAAGGTGCGACACGGTAGAAGAAACTAAAGGCAACCAGCAGCCGAGGAGGTTTAACAGGACTTCGCTAACTAATTACGATCTGATAAGGCACTAGAGACCACAGAGCAGACCACTCCGCAACCTACATCCTAAGAACGATCCCGGTAAGCATTAGGAGACCAAATCAAGAGGAAGGCATGGGCCTAGGAACTGTCAGCAGATCTGCGGAGAAGAGTGGATGGCGAATTGGTGGAGGCTTGGAATAGATGGATCAGGATAACGACTTGCCATGACGGGTGCGGCTCAGATAATAATCCCCCCATTTCCCAATGGATGCGTCTAGAGAGATATCAATCGCTGGCAATAGACCTACCAATGGAGCTACAGGTAAGCGTGGGCCGCCTACCCCTCGGTAACACACCGCCCGTCACACCACGAGAGTTGGTAATACCCGAAGCCGGTGGCCTAACCTTCGGGAAGGAGCCGTCTAAGGTGGGACAGATGATTGGGGTGAAGTCGTAACAAGGTAGCCGTATCGGAAGGTGCGGCTGGATCA |

FIG. 16AAO

| | | | |
|---|---|---|---|
| Clostridium_difficile_QCD_76w55_NCBI_ABHEO2000055 | Clostridium_difficile | ABHEO2000005 5 | SEQ ID NO: 167 | AAGCTTGAGACATCCAATGAGACATCTGTAATGGGAGGAGTTCCCTTCGGGGAGCTTGGTGTCTTAGTTGGTGCATGGTGTC GTCAGCTCGTGTCGTGAGATGTTGGGTTAAGTCCCGCAACGAGCGCAACCCTTGTCTTAGTTGCCATCATTAAGTTGG GCTACTCTAGAGAGACTGCCAGGGATAACCTGGAGGAAGGTGGGGATGACGTCAAATCATCATGCCCCTTATGCTTAGG GCTACACACGTGCTACAAATGGGTAGTACAATGAGAAGCAAGCCCGCGAGGGTAAGCAAAACTCAATCTCAAAGCTACTCTCAG TTCGGATTGTAGGCTGCAAACTCGCCTACATGAAGCTGGAGTGAATACGTAGTCTGCGGTGAATGCGCGGTGAATGCGG GAAGCTCGAAGGTGGAATCGATAAATCCTAAGACGTCGAACCACCCGTCGAAGGTGCGGCTGGATGAC CTCTTTCT |
| Clostridium_difficile_R20291_NCBI_FN54 5816 | Clostridium_difficile | FN545816 | SEQ ID NO: 168 | TTGAGAGTTTGATCCTGGCTCAGGATGAACGCTGGCGGCGTGCCTAACACATGCAAGTTGAGCGATTACTCGGTAAA GAGCGGGCGGACGGGTGAGTAAGCCTGTACACACGGATAACATAACCGAAAGGTATGCTAATACG GGATAATATATTGAGAGGCATGTCTTGAAATCAAAGGTGAGCCAGTACAGGATGGACCCGCGTCGTATTAGCTAGTTG GTAAGGTAACGGCTTACCAAGGCGACGATAGCCTAGCCGACCTGAGAGGGTGATCGGCCACATTGGAACTGAGACACGG TCCAAACTCCTACGGGAGGCAGCAGTGGGGAATATTGCACAATGGGGGAAACCCTGATGCAGCAACGCCGCGTGAGTG ATGAAGGCCTTCGGGTCGTAAAACTCTGTCCTCAAGGAAGATAATGACGGTACTTGGGGAGGAAGCCCCGGCTAACTAC GTGCCAGCAGCCGCGGTAATACGGTAGGGGGCAAGCGTTAGGCGGATATATTAAGCGTAAGGGTGAGAGATGAGTACTA TGACGCTGAGGCACGACAAAGCGTGGGGAGCAACAGGATTAGATACCCTGGTAGTCCACGCCGTAAACGATGAGTAGTA GGTGTCGGGGGTTACCCCTCGGTGCCGCAGCTAACGCATTAAGCACTCCGCCTGGGGAGTACGCTCGCAAGAGTGAAAC TCAAAGGAATTGACGGGACCCGCACAAGCAGCGGAGCATGTGGTTTAATTCGAAGCAACGCGAAGAACCTTACCT AGGCTTGACATCCAATGACAATTCCTTAATCGGGGACATTGGGGACACCCCTTGGCCATGACGGTTGTACAGGTGTG GCACTCTAGAGAGACTGCCAGGGATCATGACAATAACCTGGAGGAAGGTGGGGATGACGTCAAATCATCATGCCCCTTATGCTTAGG GCTACACACGTGCTACATGGGTAGAATGGGTAGCAAACAAATAGAGAAGCAAATCCTTAAAGAACTCGGTCAATG TTCGGATTGTAGGCTGCAAACTCGCCTACATGAAGCTGGAATCGCTAGTAATCGCAGATCAGAATGCTGCGGTGAATACG TTCCCGGGTCTTGTACAAGCATCGAATAACTCGGATCCATCGAATCAGATCAGAATGGTTGACGCTGGTGATGCC TCCTTTCT |

FIG. 16AAP

| | | | |
|---|---|---|---|
| Clostridium_difficile_VPI_10463_NCBI_AF072473 | Clostridium_difficile | AF072473 | SEQ ID NO: 169 | AGTTTGATCCTGGCTCAGGATGAACGCTGGCGGCGTGCCTAACACATGCAAGTTGAGCGAAGTTTACTTCGGTAAAGAGCGG GCGGACGGGTGAGTAACGCGTGGGTAACCTGCCTCATACAGGGGGATAACAGTTGGAAACGACTGCTAATACCGCATAA TATATTGAGAGGCATCTCTTGAATATCAAAGGTGAGCCAGTAACCCGCGTCGATTGATAGGTTGTTGGTAAGGA TAACGGCTTACCAAGGCGACGATCAGTAGCCGACCTGAGAGGGTGATCGGCCACATTGGAACTGAGACACGGTCCAAA CTCCTACGGGAGGCAGCAGTGGGGAATATTGCACAATGGGCGAAAGCCTGATGCAGCAACGCCGCGTGAGTGATGAAG GCCTTCGGGTCGTAAAACTCTGTCTCCAAGGAAGATAATGACGTGTAGGGAATATGGGCGGTGAGTTGATCTTAATAGCA CAGGAGTGAAGGCTACGCTAAGGGTGAAATGCGGTCGAAGCCTCTAGAATCAAGGAGACCAACAAACTGTGCGAAGT TCCTAGTGTAGCGGTGAAATGCGTAGATATTAGGGAGGAACACCAGTGGCGAAGGCGGCTCTCTGGACTGTAACTGACGC TGAGGCAACGAAAGCGTGGGGAGCAAACAGGATTAGATACCCTGGTAGTCCACGCCGTAAACGATGAATACTAGGTGTC GGGGGTTACCCCCCTCGGTGCCGCAGCTAACGCAATTAAGTATTCCGCCTGGGGAGTACGCTCGCAAGAGTGAAACTCA AGGAATTGACGGGGACCCGCACAAGCAGCGGAGCATGTGGTTTAATTCGAAGCAACGCGAAGAACCTTACCTAAGCTT GACATCCCAATGACATCTCCTTAATCGGAGAAGTTTCCTTCGGGACAGATTGGTGACAGGTGGTGCATGGTTGTCGTCAGC TCGTGTCGTGAGATGTTGGGTTAAGTCCCGCAACGAGCGCAACCCTTGTCTTATGTTGCCATCATTAAGTTGGGCACTCT ATAGAGACTGCCAGGGATAACCTGGAGGAAGGTGGGGATGACGTCAAATCATCATGCCCCTTATGCTCTGGGCTACACA CGTGCTACAAATGGGTAGTACAGAGGGTTGCCAAGCCGTAAGGTGAGCTAATCCCAGAAAACTACTTCAGTTCGGATT GTAGTCTGCAACTCGACTACATGAAGCTGGAATCGCTAGTAATCGCGAAATCAGAATGTCGCGGTGAATACGTTCCCGGG TCTTGTACACACCGCCCGTCACACCATGAGAGCCGGGGGGACCCGAAGTCGGTGAGCTAACCGCAAGGAGCGCGCCGT CCAAGGTAGGATCGGAATCAATAACTGGGGTGAAGTCGTAACAAGGTAACC |
| Clostridium_disporicum_DS1_NR_026491 | Clostridium_dispori cum | NR_026491 | SEQ ID NO: 170 | GCTCAGGACGAACGCTGGCGGCGTGCCTAACACATGCAAGTCGAGCGAGTTGATTCTTCCCGGAGATGAAGTGAAGCGATAGCG CGGACGGGTGAGTAACACGTGAGTAACCTGCCTCATAGAGGGGAATAGCCTCCCGAAAGGGAGATTAATACCGCATAA GATTGTAGCTTCGCATGAAGTAACTATGAAGATCCGCTATGAGATGGGCCCGCGTCCGATTAGCTAGTTGGTG AGGTAACGGCTCACCAAGGCCGACGATGGGTAGCCGAGCTGAGAGGTCGAACGGCCACATTGGGACTGAGACACGGCC CAGACTCCTACGGGAGGCAGCAGTGGGGAATATTGCACAATGGGCGAAAGCCTGATGCAGCAACGCCGCGTGAGTGAT GAGGGCCTTCGGGTTGTAAAGCTCTGTCTTCAGGGACGATAATGACGGTACCTGAGGAGGAAGCCACGGCTAACTACG TGCCAGCAGCCGCGGTAATACGTAGGTGGCAAGCGTTGTCCGGATTTACTGGGCGTAAAGGGAGCGCAGGCGGATGGAAT GGAATTCCTAGTGTAGCGGTGAAATGCGTAGAGATTAGGAAGAACACCAGTGGCGAAGGCGGCGATTCTCTGGACCGTAACT GACGCTGAGGCTCGAAAGCGTGGGGAGCAAACAGGATTAGATACCCTGGTAGTCCACGCCGTAAACGATGAATACTAG GTGTAGGGGGCTCTGCCCCTTCAGTGCCGCAGCTAACGCAATAAGTATTCCGCCTGGGGAGTACGGTCGCAAGATTAAA ACTCAAAGGAATTGACGGGGACCCGCACAAGCAGCGGAGCATGTGGTTTAATTCGAAGCAACGCGAAGAACCTTACCTA AGCTTGACATCGTGTCGTCAGAGATTGGGAAATCCCTTCGGGCACACGATGACAGGTGGTGCATGGTTGTCGTCAGCT CGTGTCGTGAGATGTTGGGTTAAGTCCCGCAACGAGCGCAACCCTTATTGTTAGTTGCCATCATTAAGTTGAGCAC TCTAGCGAGACTGCCCGGGATAACCGGGAGGAAGGTGGGGATGACGTCAAATCATCATGCCCCTTATGTCCTGGGCTA CACACGTGCTACAATGGCAAGTACAGAGGGAAGCGAAACCGCGAGGTGGAGCCAATCCCAGAAAATCTTGTCTCAGTTCGG ATTGTAGGCTGCAACTCGCCTACATGAAGCAGGAATCGCTAGTAATCGTGGATCAGCATGCCACGGTGAATACGTTCCC GGGCCTTGTACACACCGCCCGTCACACCATGAGAGTTGGCAACACCCGAAGTCGGTGAGCTAACCGCAAGGAGGAGA GCGTCTAGGTAGGGTCAGCGATTGGGGTGAAGTCGTAACAAGGTAGCCGTAGGAGAA |
| Clostridium_disporicum_NML_05A027_N CBI_DQ855943 | Clostridium_dispori cum | DQ855943 | SEQ ID NO: 171 | CATGCAAGTCGAGCGAGCGGGGACGGGTGAGTAACACGTGCCTCGCTCATAGAGGGGAATAGCCTCCCGAA AGGGAGATTAATACCGCATAAGGAGATTGTAGCTTGCATGCAAGTAACTATGAAGAACGCTATGAGATGGGCCTGCG TCCGATTAGCTAGTTGGTGGTGTAAGGGCGACCAAGGCGACGATCAGTAGCCGACCTGAGAGGGTGAACGGCCACAC GGGGACTGAGACACGGCCCAGACTCCTACCGGGAGGCAGCAGTGGGGAATATTGCACAATGGGCGAAAGCCTGATGCAGCGC GGGTTGTAAAGCTCTGTCTCAGGGACGATAATGACGGTACCTGAGGAGGAAGCCACGGCTAACTACGTGCCAGCAGCC GCGGTAATACGTAGGTGGCAAGCGTTGTCCGGATTTACTGGGCGTAAAGGGAGCGCAGGCGGACTTTTAAGTGAGATGTG AAATACCCCGGGCTCAACCTGGGGACTGCATCTCATAACTGGAAGCTAGAGTGCAGGAGAGGAAAGTGGAATTCCTAGTG TAGCGGTGAAATGCGTAGAGATTAGGAGGAACACCAGTGGCGAAGGCGACTTTCTGGACTGAAACTGACGTGAGGCGC GAAAGCGTGGGGAGCAAACAGGATTAGATACCCTGGTAGTCCACGCCGTAAACGATGAATACTAAGTGTTAGCAGGTA TCGACCCTGCTGTGCCGCAGCTAACGCAATTAAGTATTCCGCCTGGGGAGTACGGTCGCAAGATTAAAACTCAAAGGAATTGACGGGGGCCCGCACAAGCGGTGGAGCATGTGGTTTAATTCGAAGCAACGCGAAGAACCTCCGGGGCTTGACATCCCAAGAACCTTTAAGAGATAAAGGGAGTGCCTTCGGGAGCTGATGACAGGTGTGCATGGTTGTCGTCAGCTCGTGTCGTGAGATGTTGGGTTAAGTCCCGCAACGAGCGCAACCCGCCTACCGTTAGTTGCCATCATTCACATCCAGTGGGGCCCAGCAGCAAAGCGACTTTTAAGGTGGGGCTAGGGAGAGATTGACCAGTGAGGCACCATGGCGTGGAGACAGCCCAGAGGGCACATCCCCCTCCCAAGGAGGAGATTAATCCGATTGGAGGTCAGCGCAGCTCGCCAAATAACTCAAGGTAAGGAGAAGAAAGCGACTTTAAGGAGTGAATGTCGTGTTTGTAGGGGGTGCCGCCCGCCTAACGCGGAGACAGCCATGGGTCTGGAGAGACAGCCCAGAGGGCACATCCCCCTCCCAAGGAGGAGAGCCTGAACCGGGGGCCCTCTTAGCGGAAATAGCCCTCATAGAGGGAGATTAATACCGCATAAGCGAGATTGGTGGTCTGACCCTGTCAGTGCAGGAGACAGCCATGGGTCTGGAGAGACAGCCCAGAGGGCACATCCCCCTCCCAAGGAGGAGATAGAGGGAGAATAGCCTGAACCGGGAAGCCTGAACCGGGGGCCCTCTTAGCGGAAATAGCCCTCATAGAGGGAGATTAATACCGCATAAGCGAGATTGGTGGTCTGACCCTGTCAGTGCAGGAGACAGCCATGGGTCTGGAGAGACAGCCCAGAGGGCACATCCCCCTCCCAAGGAGGAGATAGAGGGAGATTAATACCGCATAAGCGAGATTGGTGGTCTGACCCTGTCAGTGCAGGAGACAGCCATGGGTCTGGAGAGACAGCCCAGAGGGCACATCCCCCTCCCAAGGAGGAGATAGAGGGAGATTAATACCGCATAAGCGAGATTGGTGGTGAAGTCGTAACAAGGTAGCCGTAGGGGAA |

FIG. 16AAQ

| | | | |
|---|---|---|---|
| Clostridium_ghonii_J CM_1400_NCBI_AB 542933 | Clostridium_ghonii | AB542933 | SEQ ID NO: 172 | CGGCACAAGCAGCGGAGCTCAGCTGTGTCGAGACTGCCCGGGTTAACGCGAGCAACGCGAAGAACCTTACCTAGAGTTGACATCGACAGGTGGTG CATGGTTGTCGTCAGCTCGTGTCGTGAGATGTTGGGTTAAGTCCCGCAACGAGCGCAACCCTTATGTTAGTTGCTACC ATGAGAACACTCTAGCAGACACTGCCGGTGACAAACCGGAGGAAGGTGGGGATGACGTCAAATCATCATGCCCCTTATGTCT AGGGCTACACACGTGCTACAAATGGCAAGAACAAAGAGAAGCAAGACCGCGAGGTGGAGCCAAATCCCATAAAGCTTGTCTCAGTTC GGATGTAGGCTGCAAACTCGCCTACATGAAGCTGGAATCGCTAGTAATCGCGAATCAGCATGTCGCGGTGAATACGTTCCC GGGCCTTGTACACACCGCCCGTCACACCATGAGAGTTGGAATACCCGAAGCATGTATCTAGGGATGTCCTAAGGTAG GGTCAGCGATTGGGG |
| Clostridium_glycolicu m_BG_C128_NCBI_ FJ844385 | Clostridium_glycoli cum | FJ844385 | SEQ ID NO: 173 | CTGGAACGCGTGCCTAACACATGCAAGTCGAGCGATTCACTTCGGTGAAGAGCGGCGGACGGGTGAGTAACGCGTGGG TAACCTGCCTCATACACATGGGATAACATACCGAAAGGTATGCTAATACGGGATAAYATAGAAAATTCACATGATATTCTTAT CAAAGCTCCGGCGGTATGAGAGGGCTTGCGCGTCTGATTAGCTAGTTGGTAAGGTAAGGGCTTACCAAGGCGACGATCA GTAGCCGACCTGAGAGGGTGATCGGCCACATTGGAACTGAGACACGGTCCAAACTCCTACGGGAGGCAGCAGTGGGG AATATTGCACAATGGGGAAGCTACTTGAGGAAGACACGGCTTCGGGTTGTAAACTTCTGTCCAGGTGGATGAAGGTAAGAGG GACTAGTAAGCTCTTTCCATGGACGATTACTACGCAGTCAGCAAAAGCTGCATTAGGTGCGTTCTTAGGAGAAGACGTCAACG ATATTAGGAGGAAACACCGTGTAATCGGTAGTCCGGCCGTAAATGGGGCACGCAAGCTGTTTCTGGGGTCAGGGCTCAAC ACAGGAATTAGATAACCTGAGGCGAGGTATAGGTACCTGAGTCAAAGAGGATACGAGGGTTTACCTACTGTGCTATAGCTCA GTAGCGCGCATTAAGTTGTTTAAATCGACAGAAGGTGACAGGTGGAAAACTCCTTTACCTAGAGTAACGCTAAACGATGATGCCTAATC GCATTTTTCCCTTCGGGGACGCAACGCAACCCTGGCACACTGAGTCGTCTAGAGGACTCCCAAGGTGACAGTGTGGGGT ACGCAAGCGAGGAGGGCGGATGACGTCAAGTCATCATGCCCCTTATGTCTAGGGCTACACACGCTACAATGGTTAGGACAGAG AGCCTAACCCTGAAAGCGCCGGATCGGCAGTCGCGAGATGCAGATATCGCACTCAGTTCGGATTGGAGTCTGCAACCCGAC TCATACACGAAGTTGGAATCGCTAGTAATCGCGAATCAGCATGCCCCGGTGAATACGTTCCCGGGCCTTGTACACACCGCCCGTCACACCATGA AGCCGAAGTCGCCACCTTAGGACTAGCTCCTACGTGAAACCCTTTGGAAGCAAGAGTCGAAGATCCAAT |
| Clostridium_glycyrrhi zinilyticum_ZM35_N CBI_AB233029 | Clostridium_glycyrr hizinilyticum | AB233029 | SEQ ID NO: 174 | TAGAGTTGATCCTGGCTCAGGATGAACGCTGGCGGCGTGCCTAACACATGCAAGTCGAGCGAAGAAGCTTACCGGATT TCTTCCGGATGAAAGTTTGTGACTGAGTGGCGGACGGGTGAGTAACGCGTGGGTAACCTGCCTATCAGCGGGGGATA ACAGTTGGAAATGACTGCTAATACCGCATAATACCGATAAGACCACACATCCGGGTTGGTAAAACTCCGGTGGTATGAGAT GGACCCGCGTCTGATTAGGTAGTAGTTGGTGGGGGTAACGGCCTACCAAGCGGACGATCAGTAGCCGACCTGAGAGGGTGATGAGGGTGAC |

FIG. 16AAR

| | | | |
|---|---|---|---|
| Clostridium_hirano nis_DSM_13275_NCBI_AB023970 | Clostridium_hirano nis | AB023970 | SEQ ID NO: 175 | CGGCCACACATTGGGACTGAGACACGGCCCAGACTCCTACGGGAGGCAGCAGTGGGGAATATTGCACAATGGGGGAAACC CTGATGCAGCGACGCCGCGTGAGTGATGAAGGTCTTCGGATTGTAAAGCTCTATCAGCAGGGAAGAAAATGACGGTACC TGACTAAGAAGCCACCGGCTAACTACGTGCCAGCAGCCGCGGTAATACGTAGGTGGCAAGCGTTATCCGGATTTACTGGG TGTAAAGGGAGCGTAGGCGGAGAGGCAAGTCTGAAGTGAAAACCCCGGGCTCAACCCGGGGAGTGCATTCAAGAACTGC TTTTCTAGAGTGTCGGAGAGGTAAGTGGAATTCCTAGTGTAGCGGTGAAATGCGTAGATATTAGGAGGAACACCAGTGG CGAAGGCGGCTTACTGGACGATGACTGACGTTGAGGCTCGAAAGCGTGGGGAGCAAACAGGATTAGATACCCTGGTAG TCCACGCCGTAAACGATGACTGACTAGGTGTCGGGAGCCCTGCCGCAGCAAGCGGTGAGCATGTGGTTTAATT CTGGGGAGTACGTTCGCAAGAATGAAACTCAAAGGAATTGACGGGGACCCGCACAAGCGGTGGAGCATGTGGTTTAATT CGAAGCAACGCGAAGAACCTTACCTGCCCTTGACATCGCCTCTGAGATGCTGAAACGATTTAGTCCCCTTCCTCGGACGC CGAGACAGGTGGTGCATGGTTGTCGTCAGCTCGTGTCGTGAGATGTTGGGTTAAGTCCCGCAACGAGCGCAACCCTTAT CTTAGTAGCCAGCATTCCCAAAATAACCACTGGCCAGACTGCCAGGGATAACCGTCTAAAAGGGATGCCAAGTCA AATCATCATGCCCCTTATGGCAGCCTACACACGTGCTACAATGGCTGGTAGTCTGCAACCCGAAGAGGAGCCAAGCCCAA CGAAAGTCCCAAAATAACTTCGGGATCTCAGTTCAGATCGGAGTCGCTAGTAATCGCGGATCAGCATGCCGCGGGTGA GAATCAGAGAATCGCGGTAAACGTCTCCGGGTCTTGTACAACACCGCCCGTC |
| Clostridium_hylemon ae_CT_9_NCBI_AB 117566 | Clostridium_hylem onae | AB117566 | SEQ ID NO: 176 | ACATGCAAGTCGAGCGATTCTCTTCGGAAGAGAGACGCGTGGGTAACGCGTGGGTAACCTGCCTTATCGCTGTACACA CGGATAACATACCGCGAAAGGTATGCTAATACCGGATAATATATCAAAGATTTTTCGGTAC AGGATGGACCCGCGTCTGATTAGCTTGTTGCGGGGATAACGCGCCACCAAGGCGACGATCAGTAGCCGACCTGAGAG GGTGATCGGCCACATTGGAACTGAGACACGGCCCAAATCTCACGGAGGCAGCAGTGGGGGAATATTGCACAATGGGC GCAAAGCCTGATGCAGCGACGCCGCGTGGAGGAAGAAGGTCTGCTGCTCAAGGAAGATAATGA CGGTACTTGAGGAGGAAGCCCCGGCTAACTACGTGCCAGCAGCCGCGGTAATACGTAGGTCTCAAGCGTTATCCGGAT TTACTGGGCGTAAAGGGTGCGTAGGAGGAAAGGCAAATGCAGTCAGGCGGTGAAATGCGTAGATATTGCCCAAACACCGGAGATAATCCTGA TACTGTCTGACTTGAGTGCACAGAAGAGGAAAGCGGGAATTCCCAGTGTAGCGGGTGAAATGCGTAGATATGTGGAGGAACAC CAGTAGCGAAGGCGGCTTTCTGGCTGTAACTGACGCTGAGGCACGAAAGCGTGGGGAGCAAACAGGATTAGATACCCTG GTAGTCCACGCCGTAAACGATGATACTAGGTGTTGGGGAGCTTCGGCTCAGCAGCTACAACAGAGTAGGAATGCGACT AATTCGAAGCAACGCGAAGAACCTTACCAGGGCTTGACATCCTTCTGAGATATCAGTAAAGCGTACCTCGGACGACAGAGTTGGT ACAGAAGGCTGAGTCAAGGAACCCTGCAGAGACAATCAAGCTACAGTTGACGGGCACGCACCGGTCAGCAAGCACCCGG CCTTGTCTTTAGTTGCCATCATTAAGTTGGGCACTCTAAAGCGACTGCCAATGGGTACTACAAGAGAGGTAAGGAGGGATGAC GTGGACAAATCCCTTCAAAGCCGTTAAGGTCCGAATGTCCGGAATCGGCGACTACAAAGCTACAGTTACTAGTTA TGCAGATCAGATGATCGTCCGGGATGGTGAATGCTGTTACACACGCCCGTCTACACACCGGGAAGTTGGGAGACA CCGAAGCCGGACTATCTAACCCTCGGGAGAGAGTCCGTGAAGGATTACAACTGAATCAAT ACCGC CATAAGAAAATGTGGTTGGTAATGGCCCGGGTAACGTCAAGTTAGGGGTTAGTAATAAGCGCTAGCGGTGCACGCACAGGCGAAGCGG TGTGACGTCCGACCTGAGGGTCGACCGCCCACATTTGGACTCAGACCGAGACACGTGGGGAATATTGCACAATGGGGG AATTGCACAATGCACACAATGTCGGCGAAAATGCACATTCGGTATGCAGCCCAATAAACATCTCATCA GCAGCGGAAGATGAGCGTTACTGGGTGTAAAAGGGAGCAACGCATGGGCAAATGCAAGTGAAGTGAATTGCCAGTGAAGC AACTGTCGTCGATTGCAATTTGGACGAAGTCGAGGAATGCCCAGTAATGTAGGAAGCGAGTACTAGGCGATAACACA AGGATTAGATACCCTGGGAGAGAATCGAACATCGACCAGGGGATCATGGTTACCGTGAATCAATAAAATCCAAGAATGGTTGGGACCCCAGGAGCAGCGGGGCCCAAGCGGTGCTACTCAGAGATTGCAAGCCGCAAGCGGGACAATCATGCC AAGGATTAGATACCGCACCAATATCCCACTGGAAGATCCAAAGAATTTACCCGTGGGCAACATCCCAAGAGAAGCGATCACGCCTTGCGATCTCATCTAGAGATA AAGCAATGCACCCCAAAGAACCCTTGCGAGTGAATAATCCGCAAGCGGTGGAGCATGCACCCGAAGCATGTGGTTTAATT CTGCCAGGATAACGTTAAGTCCCGCAACGAGCGCAACCCCTTATGCCCTTATGACATGTTGCCGCATGGTGTCGTCAGCT CGTGCCGGGATGAAGGGAAGCAACGAAGCGCAACACCCTATACAAAGCGTGAAACGGTCACACACAGTGGCT ACAATGCGATATAACAGTGGGATGCAAAGCGTCAATACTCAGTTCAGTTCGGATCGCAGTCTGCAACTGGCCGCAGTGTGTTATCGT CGACTACAGAAGCTGGAATCGCTAGTAATCGCGGATCAGCATGCCGCGGGTGAATACGTTCCCGGGCCTTGTACACACCG |

FIG. 16AAS

| | | | |
|---|---|---|---|
| Clostridium_hylemon ae_DSM_15053_NCBI_AB023973 | Clostridium_hylemonae | AB023973 | SEQ ID NO: 177 | CCGTCACACCATGGGAGTCAGTAACGCCCGAAGGTGTACCTAAGGAGCCGTCGAAGGTGGGACCGATAACTGGGG<br>TGAAGTCGTAACAAGGTA<br>AGGATGAACGCTGCCGCGTGCTTAACACATGCAAGTCGAACGAAGCAATACTGTGTGAAGAGATTAGCTTGCTAAGAT<br>CAGAACTTTGTATTGACTGGGATAACCGCATAAGTGATTAATACCGATAAACAGGGGATAACAGACTA<br>GAAATGGCTGCTAATAACCGGATAAGCCTGAGTGAGTACCGCATGGGGTCAGTAGGGGTAAAACCTCCGGTGGTGTAAGATGGCCCG<br>GCGTCTGATTAGTAGTTGGTAGGGTAACGGCCTACCAAGCCGACGATCGGTAGCCGACCTGAGAGGGTGACCGGCCA<br>CATTGGACTGAGACACGGCCCAAACTCCTACGGGAGGCAGCAGTGGGGAATATTGCACAATGGGCGAAAGCCTGATGC<br>AGCGACGCCGCGTGAAGGAAGAAGTATTTCGGTATGTAAACTTCTATCAGCAGGGAAGAAGAAGTGACGGTACCTGACTAA<br>GAAGCCCCGGCTAACTACGTGCCAGCAGCCGCGGTAATACGTAGGGGCAAGCGTTATCCGGATTTACTGGGTGTAAA<br>GGGAGCGTAGACGGCATGGCAAGTCGAAGTGAAATTCCTAGTGCTAGCGGTGAAATGCGTAGAGATATGGAGGAACACCAGTGGCGAAGGCT<br>GCGTCTCTGGACGATGATTACTGACGCTGAGGAGCGAAAGCCAGGGGAGCAAACAGGATTAGATACCCTGGTAGTCCACG<br>CCGTAAACGATGATTACTGATTAGTGCCGAAGCGATTCGGGGTGGAATGGGCAAAGGATTAGATACCCTGGTAGTCCACC<br>AGTACGTTTCGGAGAGAATTGAACTGTAAGGCACCCGCACACATACTCCCGAAGTATGCGCAAATCGCCAATCCGGG<br>GTGTCCATGGTCGTCAAGACTCCGGTGACATGTGCATCAGAGACTGCAAACCGGCCCACCACCGACCCGTGAGACAGGCAAATCCGGG<br>CCGCTTATGCGTGACCAGGCCACTCTTAACCTCGGAGAGAATCATCGCCGCAACCGCGGCAACCCTGAAAGTCCAAGC<br>GCCCGCAATTAGAATACGGGAGGTACGGGTCTGATTTCGAACTGCAACTGCAATCATGAAAGCTCGGGCTAGTGACAGAATCATCAT<br>CAAAATCCATGCTTCGGTGACAGACTCTGAATACGCTCCGCTGTTGTACATAGAACGCTGCTAGTAACGCCCGAAGCCCGGGTGA<br>TGTCCGGGGTGAATACGTTCCCGGGCCTTGTACACACCGCCCGTCACACCATGGGAGTCAGTAACGCCCGAAGCCGGTGA<br>CCTAACCGCAAAGGAGGAGCCGTCGAAGGTG |
| Clostridium_hylemon ae_TN_271_NCBI_AB023972 | Clostridium_hylemonae | AB023972 | SEQ ID NO: 178 | CTTTGTATTGACTGGTGGGCGAACGGGTGAGTAACGCGTGGGCAACCTGCCTTACACAGGGGATAACAGCTAGAAAT<br>GGCTGCTAATACCGGATAGACCTCAGTGAGGGGTAAAAACTCCGGTGGTGTAAGATGGGCCCGCGT<br>CTGATTAGTAGTTGGTAGGGTAACGGCCTACCAAGCCGACGATCAGTAGCCGGCCTGAGAGGGTGACCGGCCACATT<br>GGACTGAGACACGGCCCAAACTCCTACGGGAGGCAGCAGTGGGGAATATTGCACAATGGGCGAAAGCCTGATGACAGCAAG<br>ACCGCGCGTGAAGGATGAAGGCCCTCGGGTTGTAAACTTCTATCAGGCGGGAAGAAGTACCGGTACCGTTAAGGGA<br>CCCCGCTAACTACGTGCCAGCAGCCGCGGTAATACGTAGGGGGCAAGCGTTATCCGGATTTACTGGGTGTAAAGGGA<br>GCGTAGACGGCAAGGCAAGTCTGAAGTGAAAGCCCGGGGCTCAACCCCCGGGACTGCTTTGGAAACTGTCTTGCTAGAGT<br>GTCGGAAAGGTGGCGGAATTCCATGTGTAGCGGTGAAATGCGTAGATATATGGAGGAACACCAGTGGCGAAGGCGG<br>CTTGCTGGACGATGATCTGACGTTGAGGAGCGAAAGCGTGGGGAGCAAACAGGATTAGATACCCTGGTAGTCCACGCCG<br>TAAACGATTGAATACTAGGTGTTGCGGGTGCCGCAGCGCAAACGTCTTTAATTCGAAGCAAC<br>GCGAAGAACCTTACCTGACTCTTGACATCCCGTGACAACCCAAGAGATTGGGGTTTCTCCTTCGGGGACACGGGAGTG<br>CATGGTTGTCGTCAGCTCGTGTCGTGAGATGTTGGGTTAAGTCCCGCAACGAGCGCAACCCTTATCGCTAGCC<br>AGCATTGAGGGGACTGCCGGGACTGCCTAGAGATAGGGCGCTACGCTCGAGGCAAGCAAGCGCAAGCAAGGTGGGGATGACGTCAA<br>ATCATCATGCCCCTTTATGACCTGGGCTACACACGCGTACAATGGTGTAGTGCAACAACGGGAAGCAAGGCAGTGATGAGGTA<br>AATAACGCAAGCGTGTGTCCGGATTGGAGTCCGCTGAACTGACCCAGGTCCTGAACATCAATGCGAATCGAGATGT<br>CGCGGTGAATACGTTCCCGGGTCTTGTACACACCGCCCGT |
| Clostridium_innocu m_B_3_NR_029164 | Clostridium_innocuum | NR_029164 | SEQ ID NO: 179 | ATGGAGAGTTTGATCCTGGCTCAGGATGAACGCTGGCGGCGTGCCTAATACATGCAAGTCGAACGAAGCTTCAGGAAG<br>CTTGCTTCCAAAAGACTTAGTGGCAACGGGTAAGTAACCTGCCCATGTGCCGGATAACTGCTCGG<br>AAACGGAGCTAAAACCGGATAGCTCATTAGTTAGGGAGCGCATCAGGAGCGCCTTCAAGGCGTGAACATGGAT<br>CGGCCACATTGGGACTGAGAACACGGGCCAAACTCCTACGGGAGGCAGCAGTGGGGAATCTTCCGCAATGGGCGAAAGCC<br>CTGAACGGTGCAATGCCGCGTGAGTGAAGAAGCATCCTCGGTTTGTAAAGCTCTGTCTTTGAAGAAGATAATCGTAGGGGAAAT<br>GAATGCTATGGTTAATACCTAGCAGTCTGACGATACCTAGGCAGGAGCCACCGGCTAACTACGTGCCAGCAGCCGCGG<br>TAATACGTAGGTGGCAAGCGTTGTCCGGATTTATTGGGCGTAAAGGGCGCGTAGGCGGTATGTTAAGTCCGGAGAAG<br>CTGAACCAGCAAGCAATTAAGCTACTGGAACTGGCGTACTTGAGTGCCGTGAAGAGAGGAGAATTCCATGTGTAGCGGT<br>GAAATGCGTAGAGATATGGAGGAACACCAGTAGCGAAGGCGGTTCTCTGGTTCAATACTGACGCTGAGGCCGAAAGCGT<br>GGGGAGCAAACAGGATTAGATACCCTGGTAGTCCACGCCGTAAACGTTGGGATACTAGGTGTGGGGGGTTGACC<br>CCTTCCGTGCCGCAGCTAACGCAATAAGTATCCCACCTGGGGGAGTACGACCGCAAGGTTAAAACTCAAAGGAATTGAC |

FIG. 16AAT

| | | |
|---|---|---|
| Clostridium_innocuum_DSM_1286_NCBI_M23732 | Clostridium_innocuum<br>M23732 | SEQ ID NO: 180 | AAATAGGATTAGATACCCTAGTAGTCCACGCCGTAAACGATGAGAACTAAGTGTTGGAGAAATTCAGTGCTGCAGTTAAC<br>GCAATAAGTTCTCCGCCTGGGGAGTAGTATGACGCAAGTTNGAAACTCAAAGGAATTGACGGGGCCCGCACAAGCGNTG<br>GAGTATGTGGTTTAATTCGAAGCAACAGGAAGAACCTTACCAGGCCTTGACATGGCATGGAGATGTTTGGGTTAAGTCGC<br>GATAATTATGGATCACACAGGTGGTGCATGGCGGTCGTCAGCTCGTGTCGTGAGATGTTGGGTTAAGTCCGCAACGAG<br>CGCAACCCTTGTCGCATGTTACCAGCACAAGTTGGGACTCTGGCGAGACTGCCGGTGACAAACCGGAGGAAGGTGG<br>GGATGACGTCAAATCATCATGCCCTTATGGCCTCAGTTGCAGTTCGGATTCGGAGATACGTCGAACTCGACTCATGAAGTCGGAATCGC<br>GGTGACAAGAAGCGGAATCAGCATGCCGGTGAATACGTTCCCGGGCCTTGTACACACCGCCCGTCAAACCATGGGAGTCAG<br>TAGTAATCGCAGATCAGCATGCTGCGGTGAATACGTTCCCGGGCCTTGTACACACCGCCCGTCAAACCATGGGAGTCAG<br>TAATACCCGGTGGCATAACCGTAAGGAGCCGTCGAAGGTAGGACCGA |
| Clostridium_innocuum_LCR25_NCBI_HQ259734 | Clostridium_innocuum<br>HQ259734 | SEQ ID NO: 181 | NCANNATGGAGAAGTTTGATCCTCAGGATGAACGCTGGCGGCGTGCCTAATACATGCAAGTCGAACGAAGTCTTCA<br>GGAAGCTTGCTTCCAAAAGACTTAGTGGCAACTGGGTGAGTAACACGTAGGTAACCTGCCCATGTCCCGGGATAACT<br>GCTCGAAACGGTAGCTAAAACCGGATAAGTATACCGGATGATGGCCCACCAAGGCGATGATGCGTAGCGCGGCCTGAGAGG<br>TGATGGAGCCTGCGACGGATTAGCTAGTTGGTGAGGTAACGGCTCACCAAGCCAAGCGATGATAGCCGTAGGGGGAAATTTCGTCAATGGGGG<br>GTAAGCCGCACATTGGAACTGAGACACGGTCCAAACTCCTACGGGAGGCAGCAGTAGGGAATCTTCGGCAATGGACGA<br>AAACCCTGACCGAGCAATGCCGCGTGAGTGATGAAGGCTTCGGATCGTAAAGCTCTGTTGTAAGTGAAGAACCGGCTCA<br>TAGAGGAAATGCTATGGGAGTGACGGTAGCTTACCAGAAAGCCACGCTAACTACGTGCCAGCAGCCGCGGTAATACG<br>TAGGTGGCAAGCGTTATCCGGAATCATTGGGCGTAAAGCGTGCGCAGGCGGATGGCAGAAGAGGCGATCATCCATGTGTAGCGGGTAGAGGG<br>GCTCAACCATTGTAAGCTATGGAAGAACACAGTGGCTAAGGGTGTGATGCCCCGAAGAGGCGATCGCGTCTGTAACACTAGG<br>GGAGCAAATAGGATTAGATACCCTAGTAGTCCACGCAAGTCTATTAAAAGCGCCTTGACATGGAAAACTCAAAAG<br>GTTAACGCAATAAGTTCTCCGCTGGGTTAATTCACACAGGTGGTGCATGGTTGTCGTCAGCTCGTGTCGTGAGATGTTGGGTTAAGTCCCG<br>GCGNTGGAGTATGGGTTAATTCGATGCAACGCGAAGAACCTTACCAGGCCTCGTCCAGCTCGTGTCGTGAGACTGCCGGTGACAAACCGGAGA<br>AGGTGGGGATGACGTCAAATCATCATGCCCTTATGCCCCGCGTAAATCATCATGCCCTTACCGCCCGTCAACCGGAGA<br>CGACTTGGGACTAGTAATCCGCAAGTAATCAGCATGCTGCGGTGAATACGTGCGACTTCGTCAAACGGAGA<br>AATCGAGTGATATCCGGTGGCATACCCGATACGCCGGGCCGTGTAAGGAGTATGCTGCGGTGAATACGTCAAAGTCGG<br>CGACTTGGGTGACAAGAAGCGAGTCAGCATGCTGCGGTGAATACGTCGAACTGCCGCAACAATGGGATAAGTCGGG<br>CTGGCTCAGGATGAACCTGGGCGGCTATGCGTAACATGGCAAGCGAACGAAGTTCGAGGAAGTTGCTTCCAAAGAG<br>ACTTAGTGGCGAACGGGTGAGTAACACGGGTAACCTGCCCATGTCCCGGGATAACTGCTCGAAACGGTAGCTAAAA<br>CCGGATAGGTATACAGAGCGCATAACGGCGTGAGTAACACAGGTAAACCTGCCCATGTCCCGGGATAACTGCTCGAAACGGTAGCTAAAA<br>TAGCTAGTTGGTGAGGTAACGGCTCACCAAGGCGATGATGCGTAGCCGCTGTAAAGCTCGAGGCTGAGGAAGCCAGAGGGCGGCAGCAGT<br>TGAGACACGGCCCAAACTCCTACGGGAGGCAGCAGTAGGGAATCTTCCGCAATGGGCGAAAGCCTGAAGCGAGCAATGC<br>CGCGTGAGTGAAGAAGGTCTTCGGATCGTAAAACTCTGTTGCCAGGGACGACGGGCGTAACCGTTGAAAGGGTGCTATCCG<br>TGACCGTAGCTTACCAGAAGCACCACGCTAACTACGTGCCAGCAGCCGCGGTAAATACGTAGTAGGGAAGCCTATTTATCGG<br>GAATCATTGGCGTAATGTGTGGAGGTCCAAGAAGGTCGCAGAATGCGGCGGTAAAAGGGCTCAAACATTGCAAGCTAT<br>GGAAACTGGTATGCTGGAGTGCAAGAAGGTCGCGGAAACGCGGCGGTAAAGCGGCGCAAGACAGACTAAGCTATAGAGAAA<br>CACCAGTGGCGAAGGCCGCGCGCTGTCTGGTTCGGAAGACCGCACGCAAAAGCGACCGCCCAAGCCGCAAGATGGTTA<br>CCCTGGGAGTAGTCCACGCCGTAAAACGATGTGAACATAGGTTGTTGGGAGCAAATAGGATAGTATCCC<br>ATTCGAAGCAACGGAAGAAACCTTACCAGGCCTTGACATCGTGTAAACATGTTGGAAACATAGGTTGCAGTTCCTC<br>ACACAGGTGGTGCATGGTTGTCGTCAGCTCGTGTCGTGAGACTACACAATGTTGAGTTAAGTCCCGCAACGAGCGCAAC<br>CCTATCATCCCCAGCACTACAAGTGGGGACTCTGGGGAGACTGCCAACATCTCAAGGGAGGAAGGCGGGGATGACGT<br>CAATCATCATGCCCCTTATGACCTGGGCTACACACGTGCTACACACACGTGAATCATCATGCATCAGCTCAGGGGAA<br>GAATCTCTAAAAGGTCGTCTCAGTTCGGATTGTAGGCTGCAACTCGCCTACATGAAGCTGGAATCGCTAGTAATGCAGA<br>TCAGCATGCTGCGGTGAATACGTTCCCGGGCCTTGTACACACCGCCCGTCAAACCATGGGAGTAGTGTGTTTA<br>CGGTGGCATACCGTAAGGAGCCGTCGAAGGTGAGCCGGCGCCGATCTCAAAGGGCCGATCCAGCGGACTGGGTGACTGGGGTTAAGT |

FIG. 16AAU

| | | | |
|---|---|---|---|
| Clostridium_innocuum_SB23_NCBI_UN DETERMINED | Clostridium_innocuum | UNDETERMINED | SEQ ID NO: 182 | AGACTTAGTGGGCGAACGGGTGAGTAACACGTAGCCAACCTGCCCATGTGTCCGGGATAACTGCTGGAAACGGTAGCTAA AACCGGATAGGTATACGGAGCCATATGCTCCGTGTATATTAAAGCGCCCATCAAGGCGGTGAACATGAACATGATGGACCTGCGCGG CATTAGCTAGTTGGTGAGGTAACGGCCCACCAAGGCGATGATGCGTAGCCGGCCTGAGAGGGTTAACCGGCCACATTGG GACTGAGACACGGCCCAAACTCCTACGGGAGGCAGCAGTAGGGAATCTTCCGCAATGGGCGAAAGCCTGACGGAGCAA TGCCGCGTGAGTGAAGAAGGTCTTCGGATCGTAAAGCTCTGTTGTAAAGGGAAGAACAAGTATGAGAGTAACTGCTCATACGTGACGGTATCTAACCAGAAAGCCACGGCTAACTACGTGCCAGCAGCCGCGGTAATACGTAGGTGGCAAGCGTTGTCCGGAATTATTGGGCGTAAAGGGTGCGTAGGCGGTTTCTTAAGTCTGATGTGAAAGGCACGGGCTCAACCCGTGTTGGCATCGGAAACTGGGAAGACTTGAGTGCAGGAGAGGAGAGTGGAATTCCTAGTGTAGCGGTGAAATGCGTAGAGATTAGGAAGAACACCAGTGGCGAAGGCGGCTCTCTGGACTGTAACTGACACTGAGGCACGAAAGCGTGGGGAGCAAACAGGATTAGATACCCTGGTAGTCCACGCCGTAAACGATGATTACTAGGTGTTGGGGGAGCTGCGGCGAGAAAGCCAAGAATCGACCCCCTGGGAGTACTCCGCCACAAGATATGAAACTCAAAGGAATTGACGGGGACCCGCACAAGCGGTGGAGCATGTGGTTTAATTCGAAGCAACGCGAAGAACCTTACCTAAGTCTTGACATCGGAAACTGGGAGACAGAGATGTGCTTTTCTTCGGAACGTTTCACACAGGTGGTGCATGGTTGTCGTCAGCTCGTGTCGTGAGATGTTGGGTTAAGTCCCGCAACGAGCGCAACCCTTACTTGTTAGTTACCATCATTAAGTTGGGCACTCTAGCGAGACTGCCCGCGAATAAGCGGGAGGAAGGTGGGGATGACGTCAAATCATCATGCCCCTTATGTCTTGGGCTACACACGTAGCCCAGCGAATCTAGAAAGTGCGTCTCAGTTCGGATCGAAGTCTGAAACCCGACTCCATGAAGCTGGAATCGCTAGTAATCGCAAATCAGAATGTTGCGGTGAATACGTTCCCGGGCCTTGTACACACCGCCCGTCACACCATGGGAGTTGGGGCCACCCGAAGTCGGTGACTTAACCCTTAAAGGGGAAGTCGTCGAAGGTGGGATCGGCGATTGGGACGAAGTCGTAACAAGGTATCCCTAC |
| Clostridium_irregulare_6V1_NR_029249 | Clostridium_irregulare | NR_029249 | SEQ ID NO: 183 | GAGAGTTTGATCCTGGCTCAGGATGAACGCTGGCGGCGTGCCTAACACATGCAAGTCGAGCGAAGTTCGGGGTGAGCG GGCGGACGGGTGAGTAACGCGTGGGTAACCTGCCTCACAGAGGGGATAACAGTTATGCTAATACAGGATAACATAGGGATCAAGTATGGAGGGAAAGCTCCGGCGGCATTCCCGAACACTCAGGAGCTGCCTGAGAGATGGACCCGCGTCCGATTAGCTAGTTGGTGGGGTAACGGCCCACCAAGGCGATGATCGGTATCCGGCCTGAGAGGGTGACCGGCCACACTGGGACTGAGACACGGCCCAGACTCCTACGGGAGGCAGCAGTGGGGAATATTGCACAATGGGCGAAAGCCTGATGCAGCAACGCCGCGTGAGTGATGAAGGCCTTCGGGTCGTAAAGCTCTGTCTCCAAGGGACGATAATGACGGTACTTGGAGAATAAGCCCCGGCTAACTACGTGCCAGCAGCCGCGGTAATACGTAGGTGGCAAGCGTTGTCCGGATTTATTGGGCGTAAAGGGTGCGTAGGCGGATATATAGGAGGAACAAGAATGACTAGGGATTGACGTAGGAGACTATTAGGAGGAGAAAACAGAATTCCTAGTGTAGCGGTGAAATGCGTAGATATTAGGAGGAACACCAGTGGCGAAGGCGGTTTTCTGGACTATAACTGACGCTGAGGCACGAAAGCGTGGGGAGCAAACAGGATTAGATACCCTGGTAGTCCACGCCGTAAACGATGAATACTAGGTGTTGGGGAGCTAAAGCTCTCAGTGCTGCAGCTAACGCATTAAGTATTCCGCCTGGGGAGTACGCTCGCAAGAGTGAAACTCAAAGGAATTGACGGGGACCCGCACAAGCAGTGGAGTATGTGGTTTAATTCGAAGCAACGCGAAGAACCTTACCTAAACTTGACATCCCTTGACCACTGAAGAGATTCAGTTTTCCCTTCGGGGGCAAGGAGACAGGTGGTGCATGGCTGTCGTCAGCTCGTGTCGTGAGATGTTGGGTTAAGTCCCGCAACGAGCGCAACCCTTATTGTTAGTTGCTACCATTAAGTTGGGGACTCTAACGAAACTGCCAGTGATAAACTGGAGGAAGGTGGGGATGACGTCAAATCATCATGCCCCTTATGTCCTGGGCTACACACGTGCTACAATGGCTAGAACAAAGAGAAGCGAGACCGTGAGGTGAAGCAAAACTCATAAAACTAGTCTCAGTTCGGATTGTAGTCTGCAACTCGACTACATGAAGCTGGAATCGCTAGTAATCGCAAATCAGAATGTTGCGGTGAATACGTTCCCGGGCCTTGTACACACCGCCCGTCACACCATGAGAGTCGGAAATGCCCGAAGCCAGTGACCTAACCGTAAGGAAGGAGCTGCCAAGGCGTGACCGATGGCTGGGGTGAAGTCGTAACAAGGTAGCCGTAGGAGAACCTGCGGCTGGATCACCTCCTT |
| Clostridium_lavalense_DSM_19851_NCBI_EF564277 | Clostridium_lavalense | EF564277 | SEQ ID NO: 184 | GATGAACGCTGGCGGCGTGCCTAACACATGCAAGTCGAACGAAGCATTTTRAATGAAGTTTTCGGATTYTGAGAT GACTAGTGGCGGACGGGTGAGTAACGCGTGGATAACCTGCCTCACACTCGGGGACAACAGTTAGAAATGACTGCTAA TACCGCATAAGCGCACAGTACCGCATGGTACAGTGTGAAAACTCCGGTGGTGTGAGAGGGTGAGATCCGCGTCTGATTAGCC AGTTGGCGGGGTAAGGCCCACCAAGGCGACGATCAGTAGCCGACCTGAGAGGGTGACCGGCCACATTGGGACTGAG ACACGGCCCAAACTCCTACGGGAGGCAGCAGTGGGGAATATTGCACAATGGGGGAAACCCTGATGCAGCGACGCCGC GTGAGTGAAGAAGTATTTCGGTATGTAAAGCTCTATCAGCAGGGAAGATAATGACGGTACCTGACTAAGAAGCCCCGG CTAACTACGTGCCAGCAGCCGCGGTAATACGTAGGGGGCAAGCGTTATCCGGATTTACTGGGTGTAAAGGGAGCGTAGA CGGATAATGCAAGTCAGATGTGAAAGGCAGGGGCTCAACCCCTGGACTGCATCTGAAACTGCATTATCTTGAGTGCCAGGA GGAGAATGGAATTCCTAGTGTAGCGGTGAAATGCGTAGATATTAGGAGGAACACCAGTAGCGAAGGCGGATTCTCTGGA CTGTAACTGACACTGAGGCTCGAAAGCGTGGGGAGCAAACAGGATTAGATACCCTGGTAGTCCACGCCGTAAACGAT |

FIG. 16AAV

| | | | |
|---|---|---|---|
| Clostridium_mayomb ei_DSM_6539T_NC BI_FR733682 | Clostridium_mayo mbei | FR733682 | SEQ ID NO: 185 | GAGTGCTAGGTGTTGGGGGGCAAATGCGTAGCGCGTGCCGTGCCAATAAGCACTCCACTCTGGGAGTACGTTCG<br>CAAGAATGAAAACTGAAAGGATTGATTGATGCAAAGCGGTGGAGCATGTGGTTTAATTCGAAGCAACGCGAAG<br>AACCTTACCAAGTCTTGACATCCTTGAGAGCGGCCCTTCCTTCGGGACAAGRGAGACAGGTGGTGCA<br>TGGTTGTCGTCAGCTCGTGTCGTGAGATGTTGGGTTAAGTCCCGCAACGAGCGCAACCCTTATCCTTAGCAGCAR<br>TRAGATGGGCACTCTAGGTGACTGCCAGGGACTAAACGATGGCGACCCTGCAAGGTGAGCAATCATCAAAATAA<br>TGATTTGGGCTACAACCTCGGAGTGTCACACGTGCTACAGTCGGAAGCTGCGAAGGTGAGCAATCAGATGGCG<br>CGTCCCAGTTCGCAGGGTCTTGTACACACCGCCCGTCACACCATGGGAGTTGGGAATACCCGAAGTCAGTGACCCAACTC<br>TGAAATACGTTCCCGGGGCTTGTACACACCGCCCGTCACACCATGGGAGTTGGGAATACCCGAAGTCAGTGACCCAACTC<br>GCARGAGAGGAGKCTGCCGAASGCGTAACGTAACGTGGGGTG |
| Clostridium_orbiscin dens_DSM_6740_N CBI_Y18187 | Clostridium_orbisci ndens | Y18187 | SEQ ID NO: 186 | GAGTTTGATCCTGGCTCAGGATGAACGCTGGCGGCGTGCCTAACACATGCAAGTCGAGCGGATTCTCTTCGGAAGAGAG<br>CGGCGGACGGGTGAGTAACGCGTGGGTAACCTGCCTCATACAGTGGGATAACATACCGAAAGGTATGCTAATACAGGAT<br>GATATAAGAGATTCACATGATGTTCTTATCAAAGCTCCGGCTATGAGATGAGACGCCGGTCTGATTAGCTAGTTGGTAA<br>GGTAATGGCTTACCAAGGCGACGATCAGCCAGACTGAGAGGTTGAACGGCCACACTGGGACTGAGACACGGCCCAGA<br>AACTCCTACGGGAGGCAGCAGTGGGGAATATTGCACAATGGGCGAAAGCCTGATGGCGCAACGCCGCGTGAGTGATGA<br>AGGCCTTCGGGTCGTAAAACTCTGTCAGCGGGGAAGAAAATGACGGTACTCGTGAGGAAGCCCCGGCTAACTACGTGCC<br>AGCAGCCGCGGTAATACGTAGGGGGCAAGCGTTATCCGGAATTACTGGGCGTAAAGGGTGCGTAGGCGGTGCTTCTAA<br>GTCAGGAGTGAAAGGCTACGGCTCAACCGTAGTAAGCTCTTGAAACTGGGAGACTTGAGTGCAGGAGAGGAAAGTGGAA<br>ATTCCTAGTGTAGCGGTGAAATGCGTAGATATTAGGAGGAACACCAGTGGCGAAGGCGGCTTCTGGACTGCAACTGAC<br>ACTGAGGCACGAAAGCGTGGGGAGCAAACAGGATTAGATACCCTGGTAGTCCACGCCGTAAACGATGAGTACTAGGTG<br>TCGGGGGTTACCCCTCGGGACTCAGTGCCGCAGCAAGTAAGCATATAAGCATTCCGCCTGGGGAGTACGTCCCAAGAGTTCATCCA<br>GCGGGGACCGATGCAATGGCGATAACCGAGAAGAAGAACCCCGAAATATGATACCGAAGAAGCCCTTACCAAGCGGGACCGACCTAGTAGGTCTTCCCGGCAAGTCCGGACTCCTAGTCTGACCTGAAGCTAACGCATTAAGT<br>GCTCGTGTGTGAAGATGTTGGGTTAAGTCCCGCAACGAGCGCAACCCTTATTGCCAGCATAGTTGGGCAC<br>TCTAGAGGGACTGCTAAATGGGTGGTACAGGAAGGCAGGGAAGACGCCAAGTTGACATCGTAGTCTGAGGAGGAATCGTAGTAGCTAGCGGAATGCGAAGCCAACATCAGGAGAATCATTTCCAGTCTGAGTGCGAAGCGGGACAATTGGGGCGAAGCGAGATGAGCGGTATGCGAAGCGG<br>ACACGTGCTACAATGGGTGGGTACAGGAGGTCGAGCGCGAAGCCGAGCCAATCGGAAGCTGAAGCCATGGTCCCAGTTCGG<br>ATTGTAGGCTGCAACTCGCCTACATGAAGTCGGAATCGCTAGTAATCGCAGGTCAGCTATACCGCAGGTGGAATACGTTCCCGGGCCTTGTACACACCGCCCGTCACACCATGGGAGTGCGAAGCGGGACCCCGAAGTCAGTGACCCAAC<br>CGCAAGGAGGCAGCCGACCACGGTGGGTTCAGCGACTGGGGTGAAGTCGTAACAAGGTAGCCGTATCGGA<br>AGGTGCGGCTGG |

FIG. 16AAW

| | | | |
|---|---|---|---|
| Clostridium_oroticum_DSM_1287T_clone_6_NCBI_FR749922 | Clostridium_oroticum | FR749922 | SEQ ID NO: 187 | GTTTGATCCTGGCTCAGGATGAACGCTGGCGGCGTGCCTAACACATGCAAGTCGAGCGAAGCACAATACTCAAGATTTC TTCGGATTGAAGAGTGTTGCAGCTGGACTGAACTGAGACTGCGTGGGTAACCTGCCTCATACAGGGGAATAA CAGTTAGAAATGACTGCTAATACCGGATAAGATTAAGAGCTCATGAGCTTATTGTGAAAAACTCCGGTGGTATGGAAT GGACCCGCGTCTGATTAGCTAGTTGGTAAGGTAAGCGCTACCAAGGCGACGATCAGTAGCCGACCTGAGAGGGTGAC CGGCCACATTGGGACTGAGACACGGCCCAAACTCCTACGGGAGGCAGCAGTGGGGAATATTGCACAATGGGGGAAACC CTGACGCAGCGACGCCGCGTGAGTGAAGAAGTATCTCGGTATGTAAACTCTGTCAGCAGGGATGAAGGTTATCCGGATTTACGG GTGTAAGATAGAGCGTAGAACGGGTGATGCAAGTGGAAGTAAGTGGAAATTCCTAGTGTAGCGGTGAAATGCGTAGAGATTAGGAAGAACACCAGTG TGTGACTTAGAGTGTCGGAGAGGTAAGTGGAATTCCTAGTGTAGCGGTGAAATGCGTAGAGATATTAGGAGGAACACCAGTG GCGAAGGCGGCTTACTGGACGATGACTGACGTTGAGGCTCGAAAGCGTGGGGAGCAAACAGGATTAGATACCCTGGTA GTCCACGCCGTAAACGATGAATACTAGGTGTCGGGGTGGCAAAGCCATTCGGTGCCGACGCAGCTAACGCAGTAAGTATTCCA TGGAGACAGGTGGTGCATGGCTGTCGCAGCTCGTGTCGTGAGATGTTGGGTTAAGTCCCGCAACGAGCGCAACCCTT TTGAAGCAGCGGCTAACGCAGGCAGGATATCTTCCTACACGCTTCCTTGGGATCCAGGGATGACGTCAAGTCTGCATCATGCCCTT ATCTTAGTAGCCAGCAGGCCCCTTATGGAGCAGGGCTACAACCTGGGACAATGGGGAGGGGAAGCCTACACGAAGCGGATAATAAAGGTGGGCAATACGTGAAGTG CAAATCATCATGCCCCAAAATAACGCTCAGTTCAGTATGGAGGCTACAACACGTGTAGTCCAACTCGACTGCCGTGAATGGAAGGAGGAATGCCGAAGGTGTAACGCCC GAGCAAATGTCCGGAGCAAACTTCATACACACCGCCCGTCACACCATGGGAGTTGGTAATACCCGAAGTCAGTGAGCTAACCGCAAGGAGGCAGGCGCCGAAGTCGTAACAAGGTAG GAAGTCAGTACGGAGCCAACCGGCTGGGGGAGCTGCCGAAGGTGGGAAGTCGTAACAAGGTAG CCGTATCGGAAGGTGCGGCTGGATCACCTCCTTTCT |
| Clostridium_paraputrificum_JCM_1293_NCBi_AB536771 | Clostridium_paraputrificum | AB536771 | SEQ ID NO: 188 | AGAGTTTGATCCTGGCTCAGGACGAACGCTGGCGGCGTGCCTAACACATGCAAGTCGAGCGATGAAGTTCCTTCGGGA ACGGATTAGCGGCGGACGGGTGAGTAACACGTGGGCAACCTGCCTTATAGAGGGGAATAGCCTTCCGAAAGGAAGATT AATACCGCATAAGATTGTAGCTTCGCATGAAGCAGTAATTAAAGGAGCAATCCGCTATAAGATGGGCCCGCGGTTGCATT AGCTAGTTGGTGAGGTAACGGCTCACCAAGGCGACGATGCATAGCCGACCTGAGAGGGTGATCGGCCACATTGGGACT GAGACACGGCCCAGACTCCTACGGGAGGCAGCAGTGGGGAATATTGCACAATGGGGGAAACCCTGATGCAGCAACGCC GCGTGAGTGATGAAGGCTTTCGGGTCGTAAAACTCTGTCCTCAAGGAAGATAATGACGGTACTTGAGGAGGAAGCCA CGGCTAACTACGTGCCAGCAGCCGCGGTAATACGTAGGTGGCAAGCGTTGTCCGGATTTACTGGGCGTAAAGGGAGCG TAGGCGGATTTTAAGTCAGGTGTGAAAGGCTACGGCTCAACCGTAGTAAGCACGCCTGAAACTGGAATCTAGAGTGCA GGAGGGAAAGTGGAATTCCTAGTGTAGCGGTGAAATGCGTAGAGATTAGGAAGAACACCAGTGGCGAAGGCGACTTT CTGGACTGTAACTGACGCTGAGGCTCGAAAGCGTGGGGAGCAAACAGGATTAGATACCCTGGTAGTCCACGCCGTAAA CGATGAATACTAAGTGTTGGGGGGCAATCCCCTCTGTGCCGCAGTTAACACAATTAAGTATTCCGCCTGGGGAGTACGGC AGAACTTCCTACTGGCAGACGATACATGTAACACATGGACTGTATCAATAGGAGTTTCCAGCGAAGGAGCAAGTGGT GCATGGTTGTCGTCAGCTCGTGTCGTGAGATGTTGGGTTAAGTCCCGCAACGAGCGCAACCCTTATTCTTAGTTGCTAC CATTTAGTTGAGCACTCTAGGGAGACTGCCGTACAAGCGGAGGAAGGTGGGGATGACGTCAAATCATCATGCCCCTT ATGTCTAGGGCTACACACGTGCTACAATGGCTGGTACAAAGAGAAGCAATACCGTGAGGTGGAGCAAAACTATAAAAC CAGTCTCAGTTCGGATTGTAGGCTGCAACTCGCCTACATGAAGCTGGAATCGCTAGTAATCGCGAATCAGAATGTCGCGG TGAATACGTTCCCGGGTCTTGTACACACCGCCCGTCACACCATGAGAGTTGGCAATACCCAAAGTTCGTGATCTAACC GTAAGGAGGAAGCCACCTAAGGTAGGGCTCAGTGACTGGGGTGAAGTCGTAACAAGGTAACC |
| Clostridium_scindens_ATCC_35704_NCBi_AF262238 | Clostridium_scindens | AF262238 | SEQ ID NO: 189 | GAGAGTTTGATCCTGGCTCAGGATGAACGCTGGCGGCGTGCCTAACACATGCAAGTCGAACGAAGCGCCTTGGCCCCGGA CTTCTTCGGAAGAAGCGAGGAGCCTTGCGACTGAGTGATAACGCGTGGGCAACCTGTCCCTGACACTGGG GATAACACCGGATAATACTGTAATACGCATGAACACACACCGCCCGGTTCGTGCCATGGCCAAAGCCCCGGCGGT GCAAGATGGGCCCGCGGCGCATTAGCTAGTTGGTGAGGTAACGGCTCACCAAGGCGACGATGCGTAGCCGACCTGAG AGGGTGAACGGCCACATTGGGACTGAGACACGGCCCAGACTCCTACGGGAGGCAGCAGTGGGGAATATTGCACAATG GGGGAAACCCTGATGCAGCAACGCCGCGTGAAGGAAGAAGGTCTTCGGATTGTAAACTTCTATCAGCAGGGAAGAAT GCAAGATGACGGTACCTGACTAAGAAGCCCCGGCTAACTACGTGCCAGCAGCCGCGGTAATACGTAGGGGGCAAGCG TTATCCGGATTTACTGGGTGTAAAGGGCGTGTAGGCGGGATGGCAAGTCTGATGTGAAAGGCCGGGGCTCAACCCCGG TACTGCATCAGAAACTGTCATTCTTGAGTGCCGGAGAGGCAAGCGGAATTCCTAGTGTAGCGGTGAAATGCGTAGATATTAGGAGG AACACCAGTGGCGAAGGCGGCTTGCTGGACGGTAACTGACGTTGAGGCGCGAAAGCGTGGGGAGCAACAGGATTAGA TACCCTGGTAGTCCACGCCGTAAACGATGATTACTAGGTGTCGGGGAGCATGCTCCCTCGGTGCCGCCGCAAACGCAT TAAGTAATCCACCTGGGGAGTACGTTCGCAAGAATGAAACTCAAAGGAATTGACGGGGACCCGCACAAGCGGTGGAG CATGTGGTTTAATTCGAAGCAACGCGAAGAACCTTACCTGATCTTGACATTGGTCGCTATTCGCAGAGATGTGAAAGC CCCTTCGGGGGAAGCAGAGACAGGTGGTGCATGGCTGTCGTCAGCTCGTGTCGTGAGATGTTGGGTTAAGTCCCGCAACGAGCGCAACCCT TATTGTTAGTTGCTACCATTAAGTTGAGCACTCTAACGAGACTGCCGGCGCTAAGCCGGAGGAAGGTGGGGATGACGT CAAGTCATCATGCCCCTTATGACCAGGGCTTCACACGTGCTACAATGGCGTAAACAAAGGGAGGCGAACCCGGAAGT GAAAGCCAATCCCAAAAAAGCACACGGGGAGGGGAACGCCCGGGAGGCGCAACCAAGTCGGAATTCGGTGAGTGGAATCGG CAAGATGGGGAACGCCCGTCAAGGAGCGATCATGCAGCTGGAATCGCTAGTAATCGCGAATCAGCATGCCGCGGTGAATACGTTCCCGG GCCTTGTACACACCGCCCGTCACACCATGGGAGTTGGCAATACCCGAAGTCAGTGACCTAACCGCAAGGAGGGCGCTT ACCACGGTGGGATTCATGACTGGGGTGAAGTCGTAACAAGGTACC |

FIG. 16AAX

| | | | |
|---|---|---|---|
| Clostridium_sordellii_TM204_NCBI_AB448946 | Clostridium_sordellii | AB448946 | SEQ ID NO: 190 | AACACCAGTGGGAAGGCGGCCTGCTGGAAGCGATGACTGAGTTGAGGCTCGAAAGCGTGGGAGCAAACAGGATTAG ATAAGTAGTCCACCTGGGAGTAACAACGGATACTAGGTGTCGGGTGGCAAGCGATGACTACTAGGTGTCCGGGTGGCAAGGAATTCAAAGGAATGAAAACTCAAAGGAATGAAAACTCCGATGGCGAAGGCAGCACAAGCGGTGGAG CATGTGGTTTAATTCGAAGCAACCGGAAGAACCTTACCTGATCTTGACATCCGATGACATCCGATCAAGGAATTCGACATCCGAAAGCGCTCTT CTTCGGAACATCGGTGACAGGTGGTGCATGGCTGTCGTCAGCTCGTGTCGTGAGATGTTGGGTTAAGTCCCGCAACGA GCGCAACCCCTATCTTCAGTAGCCAGCATTTTGGATGGCACTCTGGAGAGACTGCCAGTGACAAGCTGCTACACGT GGGGATGACGTCAAATCATCCATGCCCCTTATGAC

FIG. 16AAY

| | | | |
|---|---|---|---|
| Clostridium_sp_D5_NCBI_ADBG010001 42 | Clostridium_sp_D5 | ADBG0100014 2 | SEQ ID NO: 192 | CCGTAAGGAGGCAGCGACCTAAGGTAGGGTGAAGTCGTAACAAGGTAGCCGTAGGAGAACCT GCGGCTGGATCACCTCCTTTCT GAGAGTTGATCCTGGCTCAGGATGAACGCTGGCGGCGTGCCTAACACATGCAAGTCGAGCGAAGCGCTTTACTTAGAT TCTTCGGATTGAAGAGTTTGACTGCTAATACCGCATAAGACTGAGACTCGCATGAGTCAGTGGTAACGGTGTAACCTGCCTCATACAGGGGGA TAACAGTTAGAAATGACTGCTAATAGCTGCATTGGTAAGTACCGCATGGGACGACGATCAGTGGCGCATGAGTCCGGTGGTATGA GATGGACCCGCGTCTGATTAGCTAGTTGGTGAGGTAACGGCCCACCAAGGCGACGATCAGTAGCCGACCTGAGAGGGT AACCCTGATCGCACGATTGGGACTGAGACACGGCCCACACTCCTACGGGAGGCAGCAGTGGGGAATATTGCACAATGGGG TACCTGACTGAGAAGCCCCGGCTAACTACGTGCCAGCAGCCGCGGTAATACGTAGGGGGCAAGCGTTATCCGGATTTA CTGGGTGTAAAGGGAGCGTAGACGGTGCTGGAGGTGAATAGCTCTAGGTGTAGCCGTGAAATGCGTAGAGGAACACC ACTATGTAACTAGAGAGTGTCGGAGACGTGCTTACTGGACTTGACGGCAGCGTGAAATGTGTAGATATGCGGAGGAACACC AGTGGCGAAGGCGGCTTACTGGACCTGTAACTGACGCCGTGAAACCAGGATTAGATACCC TGTAGTCCACGCCGTAAACGATGATTACTAGGTGTCGGGTGGCAAAGCCATTCGGTGCCGCAGCTAACGCAATAAGTAT TCCACCTGGGGAGTACGTTCGCAAGAATGAAACTCAAAGGAATTGACGGGACCGGCCGAGGAGCTGTGGCATG TTAATTCGAAGCAACGCGAAGAACCTTACCTGTCCTTGACATCCCACTGACGAGACTAGAGATGAGTCCTTCCCTTCGGG ACAGTGAGACAGGTGGTGCATGGTTGTCGTCAGCTCGTGTCGTGAGATGTTGGGTTAAGTCCCGCAACGAGCGCAAC CCTTATCTTAGTTGCCGAATGCGTAAAGGCAGGCACTCAAGAGTGACTCGCAGCGGGAAATTGATAGGGATCAAC AGTGAAATCATCATGCCCCTTATGACCAGGGCTACACGGAGACAAAAGGAGGGATG AGTTGAGCAAGTCGCCCCAAAAATACCCAGAATGCGCGCTAAATACCACACATACAAACCGAGAGGCGGGATCAACCGCAAGGTGAAGCTAATCGCAGTCGTAGTA ATCGCGAATCAGAATGTCGCGGGTGAATACGTTCCCGGGTCTTGTACACACCGCCCGTCACACCATGGGAGTTGGTAATACCCGAAGCCG AGCCGTACGAAGTGTGAAGGTGGATCACCCTTCT |
| Clostridium_sp_HGF 2_NCBI_AENW0100 0022 | Clostridium_sp_H GF2 | AENW0100002 2 | SEQ ID NO: 193 | TCAAATGAGAGTTTGATCCTGGCTCAGGACGAACGCTGGCGGCATGCCTAATACATGCAAGTCGAACGAAGTTTCGAG GAAGCTTGCTTCCAAAGATCAAAGTGGCAAACGGGTAGTGGCGAACGGGTGAGTAACACGTGGAGTAACCTGCCCATGTGCTGGGATAACTG CTGGAAACAGTGGCTAATACCGGATAAAACCCGAGACGGCATCGTCTCGGGGAAAGATTTTATTAAGGCGGCCTGAACAT GTAAACGCGACTGCGGCGGCACATTGGGTACGGGAGACACACATGCCCTCCACAAGGGGACTAGCGGCGGCCTGAGAGG GTAACCGGCCACAATGGGACTGAGACACGGCCCAAACTCCTACGGGAGGCAGCAGTGGGGAATATTGCACAATGG GCGAAAGCCTGATGCAGCGACGCCGCGTGAGTGATGAAGGCCTTCGGGTCGTAAAGCTCTGTCTTTAAGAGAAGAACGTC AGTGGCAAGTGCAACACCTGAAGCTTGACGGTACCTTACCGAAGGCCACGGCAACATACGTGCCAGCAGCCGCGGTAATACG TAGGTGGCAAGCGTATGCCGGAATCATTGGCGTAAGTGCGCGTGGCAAAGCTAGGTGTGCTATGAATCATACCGACGCGACG AAGCCCAACATCCGGGTTAAGGCGGCGGTATATGCGTGGAATGCGAAGCTCGAGTAGTGCATGGCGAAGCGTCTGGGA GGTCAACACTATAATACCCTACCTAGCAAGGCGGCGCGAAGGCTCAAATCACCAGTAATCAAAACAAGCTAGGAGGGCAAGCTGCAGCGGCCCGAAAGGCGATTGAACGCCCCGCAAGCGACAGCCTGTAGTCACGCCTAGAGGCACGCCGGGGAAGCGCGG GAAGCAAATAGCGATTAGATACCGCTAGTAGTCCACGCCGTAAACGATGAGTACTAGGGTTGACCTGACATCCTAACG TTAACAGCAATAAGTTCTCCGCCTGGGGAGTACGCCGCAAGGTTGAAACTCAAAGGAATTGACGGGGGCCCGCACA GCGGTGGAGTATGTGGTTTAATTCGACGCAACGCGAAGAACCTTACCAAGTCTTGACATCCGGTGACCGCCGTAGAGA TAGGAGGTTCCCTTCGGGACACCGGTGACAGGTGGTGCATGGTTGTCGTCAGCTCGTGTCGTGAGATGTTGGGTTAAGTCCCGCAACGAGCGCAACCCTTGATCCTCAGTCGCCAG AAACCCTGACAAGCCCCTTATGCGGCATCAAGGTGCTGCATGGCTGTCGTCAGCTCGTGTCGTGAGATGTTGGGTTAAGTCCCGCAACGAGCGCAACCCTTGTGGCTAGTTACCACAACGAGCTGCTCAACCGATGACGACGACGGAGGAGG AGTTGGGATGACGTCAAGTCATCATGCCCCTTATGCCCTGGGCTACACACGTGCTACAATGGCATATACAACAGCAGG GCGACAGTGTTCAGGCTCGGAGCGAATCTCAAAAAGTATGCCCCAGTTCGGATTGCAGGCTGCAACCGTAGAGCAG CGACTTGGTGAATACGTTCCCGGGCCTTGTACACCGCCCGTCACACCATGGGAGTTGGGAATACCGGAAGTGGTGCA CGTAAGCAAGGTATCCCACCGAAGGGGATGGGATCACCTTTGGATACG GCTCAACCCACAGAAGACAACAATGCCTTGTGCAAGTAGGGGTGCACGTGAAGTCGTAACAAGGTAGCCGTAGGAGAACCTGCGGCTGGATCACCCTTTCT |
| Clostridium_spirof orme_DSM_1552_NC BI_X73441 | Clostridium_spirof orme | X73441 | SEQ ID NO: 194 | GAGAGTTTGATCCTGGCTCAGGACGATGAACTGCCTAATACATGCAAGTCGAACGAAGCGGAGCAGCAATGCTGCTGA GTGGCGAACGGGTGAGTAACACATAAGTAACCTGCCCTCGAGAGGGGATAACAGTCTGGAAAACCAGTCTAATAGGATAATATACGCCGGGAAGGCGCGCCCTGAGAGGCGGTCCGCATTGGACGAGTAGATACACTAGAGAGCCAAGACAATGGCGGATAAGTGCCTGGGCAGCAGCGGCGGCGCTACAGCTGGCGCCGCCCATGGGCTGCCGGATATGGGTGCCTCCAAGTGCCACTGGTTAAGAGAGTTCGCAGCCTGGAAGGCAGCCCGCGCATGAGCTGAAGCAGGTCCGGCCATAGCCTGTGGTT GGTGAGGTAACGGCTCACCAAGGCGACGATCCTAGCCGGACTGAGAGGTTGACCGGCCACACTGGAACTGAGACACGGTCCAGACTCCTACGGGAGGCAGCAGTGGGGAATCTTCCACAATGGACGAAAGTCTGATGGAGCAACGCCGCGTGAGTGAAGAAGGTCTTCGGATTGTAAAGCTCTGTCATCAGGGACGAACAGAAGGACGTGTTAATAGCACGTCCCTTGACGGTACCTGATGAATAAGCACCGGCTAACTACGTGCCAGCAGCCGCGGTAAGACGTAGGTGGCAATGCGTAATATCCGGATTATTGGGCGTAAAGAGCATGTAGGCGGCAGCTAAGTCAGACGTGAAATCCTGAGGCTCAACCACAGAAGTGCGTTTGAAACTGGCTGACTTGAGTGCAGAAGAGGAGAGTGGAATTCCTAGTGTAGTGGTGAAATGCGTAGATATAGGAAGAACACCAGTGGCGAAGGCGACTCTCTGGTCTGTAACTGACACTGAGGTGCGAAAGCGTGGGGAGCAAATAGGATTAGATACCCTAGTAGTCCACGCCGTAAACGATGAATGCTAGGTGTTGGGGATCTCAGTTCTCAGTGCTGCAGTTAACACAATAAGCATTCCGCCTGGGGAGTACGTCCGCAAGGTTGAAACTCAAAGGAATTGACGGGGGCCCGCACAAGCGGTGGAGCATGTGGTTTAATTCGAAGCAACGCGAAGAACCTTACCAAGGCTTGACATCCGGAGGTCAAGCTGAGGTTCAATCAAGGGCAATCTCCTGGGAGACGACGGACCCGAAGGTGCATGGTTGTCGTCAGCTCGTGTCGTGAGATGTTGGGTTAAGTCCCGCAACGAGCGCAACCCTTATGATTAGTTACCACAACGAGCTGGGGAGACTCTAATCGAACTGCCGTGATTCAACTGAGGAAGGCGAGGGATGACGTCAAATCAGTCATGCCCCTTATGCCCTGGGCAATGCGAGCGCAATGCTGACATGGCGAACCAGTACAGAAGGTATGGCCCACACTGTCGGGACTGCGAGCGCAGAAACACTGGAGCCCACCCTAGAAAGGTGGGATCCGCGTAGCGCGGATCCAATCCAGAATGCCCCAGGTTCAGAAGGAGGCGGGCCACACTAGCGGGTGAAGCAACTGACTGGAGCTTGGAGGCGGAGCCGTGGGGTAGGGCACGACCGTAGCAAGGCCGGATCAACCCATGGCGAAACAGCAGGCTAATCTTGAACCTAGGCGAAGTGTGCCGCGCCATTATGGGTGAGCCACCCGATAGGGTGTGAGGCGTGGATTGGAGAGGCGAAAGGACCCGGGCGTGGCGGGACGACGAAGGCGCCGTTATCGCGTGACCGCAAGGAGGCAGGCGTCGAAGGCCCCACCGGCGCACCGCAGTCGCCGGGACGGCGGGCGATAGCCGGGTCAGCCTGAACGGAGCTGGTGAGTATGCTGGTGACCAGGTCGATGGCTGAGAACCAGCAGGTTGCGGCCGCAGGTGAGCTGCAACACCGGAAGAGAACCGGGATGGCGGGCGAGCACTAGCAACGCCACCGGCAAGCACTGTCCCCCGCCTACGAGCCCAGCCTCTCGCGCCCGACCCCGCCAGGAGGCGGGAACCCTCAGCTGGGCCCACAGCCCGTCGGCGAGCAGCAGCACGCCGCCGTGGGCAAGGTATCCCACCGAAGGGGATGGGATCACCTTTGGATACG GCTCAACCCACAGAAGACAACAATGCCTTGTGCAAGTAGGGGTGCACGTGAAGTCGTAACAAGGTAGCCGTAGGAGAATGCTGGAATCGAAGCTGAAGTAGGGGTGAAGTCGTAACAAGGTAGCCGTAGAGGAAGCTGGAATCGAAGCTGAAGTAGAGGAAGAAGAACCGGGATGGCGGGCGAGCACTAGCAACGCCACCGGCAAGCACTGTCCCCCGCCTACGAGCCCAGCCTCTCGCGCCCGACCCCGCCAGGAGGCGGGAACCCTCAGCTGGGCCCACAGCCCGTCGGCGAGCAGCAGCACGCCGCCGTGGGCAAGGTATCCCACCGAAGGGGATGGGATCACCTTTGGATACG |

FIG. 16AAZ

| | | | | |
|---|---|---|---|---|
| | | | | CTTTATGAGAAAGCCACGGCTAACTACGTGCCAGCAGCCGCGGTAATACGTAGGTGGCGAGCGTTATCCGGAATTATTGGGCGTAAAGAGGGAGCAGGCGGCGGCAGAGGTCTGTGGTGAAAGACTGAAGCTTABACTTCAGTAAGCCATAGAAACCGGGCTGCTAGAGTGCAGGAGAGGATCGTGGAATTCCTGTGTAGCGGTGAAATGCGTAGATATATGGAGGAACACCAGTGGCGAAGGCGACGGTCTGGCCTGTAACTGACGCTCATTCCCGAAAGCGTGGGGAGCAAATAGGATTAGATACCCTAGTAGTCCACGCCGTAAACGATGAGTACTAAGTGTTGGGAGTCAAATTTCAGTGCTGCAGTTAACGCAATAAGTACTCCGCCTGAGTAGTACGTTCGCAAGAATGAAACTCAAAGGAATTGACGGGGGCCGCACAAGCGGTGGAGCATGTGGTTTAATTCGAAGCAACGCGAAGAACCTTACCAGGTCTTGACATCCGGATAAAGACCTCAGAGATGAGGGGATAGATATATCCGAGACAGGTGGTGCATGGTTGTCGTCAGCTCGTGTCGTGAGATGTTGGGTTAAGTCCCGCAACGAGCGCAACCCTTGTCGCTAGTTACCATCATTAAGTTGGGGACTCTAGCGAGACTGCCAGTGACAAGCTGGAGGAAGGCGGGGATGACGTCAAATCATCATGCCCCTTATGACCTGGGCTACACACGTGCTACAATGGATGGAGCAGAGGGAAGCGAAGCCGCGAGGTGAAGCAAAACCCATAAAACCATTCTCAGTTCGGATTGTAGTCTGCAACTCGACTACATGAAGTTGGAATCGCTAGTAATCGCGAATCAGCATGTCGCGGTGAATACGTTCTCGGGCCTTGTACACACCGCCCGTCACACCATGAGAGTTGATAACACCCGAAGCCGGTGGCCTAACCGCAAGGAGGGAGCTGTCTAAGGTGGGATTGATGATTGGGGTGAAGTCGTAACAAGGTATCCCTACGGGAACGTGCGGCTGGATCACCTCC |
| Clostridium_sp_MT4_E_NCBI_FJ159523 | Clostridium_sp_MT4_E | FJ159523 | SEQ ID NO: 195 | CATGCACGTCGAGCGACTCTTCTGGAGAGAGCGGCGGACGGGAGAGCACGCGAGGGTACCTGCCCTGTCACACGGATAACACTACCGAAAGGTATACTAATACGGGGACTAACATACTGAAAGTCGCATGGCTTTTGTATCAAAGCTCCGGCGGTACAGGATGGACCCGCGTCTGATTAGCTAGTTGGTAAGGTAATGGCTTACCAAGGCAACGATCAGTAGCCGACCTTGAGAAGGGTGAATCGGGCCACTACTGGAAATGAAGACACGGGTCCAAGACTCCTACTGGGGAGGCAGCAGTGGGGAATATTGCACAATGGGCGAAAGCCTGATGCAGCAACGCCGCGTGAGCGGATGAAGGCCTTCGGGTCGTAAAGCTCTGTCCTCAAGGAAGATAATGACGGGTACTTTGAGGAGGAAGCCCCGGGCTAACTACGTGCCAGCAGCCGCGGTAATACGGTAGGGGGCTAGCGTTATCCGGGAAATTACTGGGCGTAAAGGGTGCGGTAAGGTGGTTTTTTTAAGTCAGAAGTGAAAGGCTACGGCTCAACCGGTAGTAAGCTTTTTGAAACTAGAGAACTTTGAGTGCAGGAGAGGAGAGTAGAATTCCTAGTGTAGCGGTGAAATGCGTAAATTTAGGAGGAATACCAGTAGCGAAGGCGGCTTCTCTGGACTTGTAACTGACACTGAGGCCGAAAGCGGGGGAGCAACAGGATTAGATCCCTGGTAGTCCCGCCGTAAACGATGAGTACTAGGGTGTCGGGGGTTACCCCCCTCGGTGCCGCAGCTAACGCATTAAGTACTCCGCCTGGGAAGTACGCTCGCAAGAGTAAACTCAAAGGAATTGACCGGGACCCGCACAAAGTAGCGGAGCATGTGGTTTAATTCGAAGCAAACGCGAAGAACCTTACCTAAGCTTGACATCCCACTGACCTCTCCCTAAATCGGAGATTTCCCTTCGGGGCCAGTGGTGACAGGTGGTGCATGGTTGTCGTCAGCTCGTGTCGTGAGATGTTGGGTTAAGTCCCGCAACGAGCGCAACCCTTGCCTTTAGTTGCCAGCATTAAGTTGGGCACTCTAGAGGGACTGCCGAGGATAACTCGGAGGAAGGTGGGGATGACGTCAAATCATCATGCCCCTTATGCTTAGGGCTACACCACCGTGCTACAATGGGTGGTACAGAGGGTTGCCAAGCCGCGAAGGTGGAGCTAATCCCTTAAAGCCATTCTCAGTTCGGATTGTAGGCTGAAACTCGCCTACATGAAGCTGGAGTTACTAGTAATCGCAATCAGAATGCTGCGGTGATGCGTTCCCGGGTCTTGTACACACCGCCCGTCACACCATTGGAAGTTGGGGCGCCAGA |
| Clostridium_sp_NML_04A032_NCBI_EU815224 | Clostridium_sp_NML_04A032 | EU815224 | SEQ ID NO: 196 | ACGCTGGCGGCGTGCTTAACACATGCAAGTCGAACGGGGTGCCTATGATAGAGGATTCGTCCAATTGATTAGGCTACCTAGTGGCGGACGGGTGAGTAACGCGTGAGTAACCTGCCTTGGAGTGGGGAATAACAGTCCGAAAGGACTGCTAATACCGCATGATGCAGCGAGGTCGCATGGCCTTGCTGCCAAAGATTTATCGCTCTGAGATGGACTCGCGTCTGATTAGCTGGTTGGCGGGGTAACGGCCCACCAAGGCGACGATCAGTAGCCGGACTGAGAGGTTGGCCGGCCACATTGGGACTGAGACACGGCCCAGACTCCTACGGGAGGCAGCAGTGGGGAATATTGGGCAATGGGCGCAAGCCTGACCCAGCAACGCCGCGTGAAGGAAGAAGGCTCTCGGGTTGTAAACTTCTTTTATCAGGGACGAAAGAAATGACGGTACCTGATGAATAAGCCACGGCTAACTACGTGCCAGCAGCCGCGGTAATACGTAGGTGGCAAGCGTTATCCGGATTTACTGGGTGTAAAGGGCGTGTAGGCGGGAAAGCAAGTCAGGCGTGAAAACTATGGGCTCAACCCATAGCCTGCGTTTGAAACTGTTTTTCTTGAGTGTCGGAGAGGCAATCGGAATTCCGTGTGTAGCGGTGAAATGCGTAGATATACGGAGGAACACCAGTGGCGAAGGCGGATTGCTGGACGATAACTGACGCTGAGGCGCGAAAGCGTGGGGAGCAAACAGGATTAGATACCCTGGTAGTCCACGCCGTAAACGATGGATACTAGGTGTGGGGGGTCTGACCCCCTCCGTGCCGCAGTTAACACAATAAGTATCCCACCTGGGGAGTACGATCGCAAGGTTGAAACTCAAAGGAATTGACGGGGGCCCGCACAAGCGGTGGAGTATGTGGTTTAATTCGAAGCAACGCGAAGAACCTTACCAGGGCTTGACATCGTACTAACGAAGCAGAGATGCATTAGGTGCCCTTCGGGGAAAGTATAGACAGGTGGTGCATGGTTGTCGTCAGCTCGTGTCGTGAGATGTTGGGTTAAGTCCCGCAACGAGCGCAACCCCTATTGTTAGTTGCTACGCAAGAGCACTCTAGCGAGACTGCCGTTGACAAAACGGAGGAAGGTGGGGACGACGTCAAATCATCATGCCCCTTATGTCCTGGGCCACACACGTACTACAATGGCGGTCAACAGAGGGAGGCAATACCGCGAGGTGGAGCAAATCCCTAAAAGCCGTCC |

FIG. 16AAAA

| | | | |
|---|---|---|---|
| Clostridium_sp_YIT_12069_NCBI_AB491207 | Clostridium_sp_YIT_12069 T_12069 | AB491207 | SEQ ID NO: 197 | CAGTTCGGATTGCAGGCTGAAACCGCTGAAGTGAAGATGAGTCGCGGATCAGCATGCCGAAT ACGTTCCCGGCCCTTGTACAACCGCCCGTCAAGTCGCTAGTAATGGAAGTTGGAACAACCTGC GGGGCGCGCGCCGGCCACCATCGGTGGGTTCGATTCAACACATCGAAGTCGTAACAAGGTAGCCGTAT GACGAACGCTGGCGGCGTGCCTAATACATGCAAGTCGAACGAGTGGCGGACGGGTGAGTAACGCTG CTCAAAGAGGGGGATAACGTCTGGAAGGCGCTCTAATACCGCATAACGAAGGACGCTAATACCGCT ATTAGCTAGTTGGTGGGGTAACAGCCTACCAAGGCGACGATCAGTAGCCGACCTGAGAGGGTGAACGG GCGGAGAGGGAAGACTGAGACACGGTCCAAACTCCTACGGGAGGCAGCAGTGGGGAATATTGCACAAT GGGGCGAAAGCCTGATGCAGCACGCGGTGATGGAAATCTCGTTGTATGTTAACGGAGATTACTACGG GCTAACTACGTGCCACAGCCGCGGTAATACGTAGGGGGCAACCAATATATTCGAATTCGCATCTAGGGA GGGGGAGAGTCAGACGGTGAGTGTATGCGAAATGCGATGTAGCGGTGAAATGCGAAGAGATTATGG GGCAGCAGGCGGGAATTCCAGCTGTAGCGGTGAAATGCGTAGATATAGGAGGAACACCAGTGGCGGAAGGC GGCTTACTGGACGGCTATTGTCCGGATTACTGGGCGTAAAGCGGTGCGCAAGTTTGGCGTAAACGAT GATTACTAGGTGTGGGATTTACCGCCCAGGTTAACAGTAAGCTGAGATGTGAGCCAAGGTTGAA ACTCAAAGGAATTGACGGGGACCCGCACAAGCAGCGGAGCATGTGGTTTAATTCGAAGCAACGCGAAGAAC CTTACCAGGTCTTGACATGCAGAGCTTGGAAGAAGCAATCCTTGATTGTCGTACAATATACGGAC GTCCTGACATCGACGACGGTGCTACAAGCCCTTGAGAGCGACTGCCAACGACAACACAACATCCTCGAA TACCGGTCAAGTCAGGAACGACGCGACAGGGCAAGTCCAAGCAATAAGGTCTGCAAAATC CCTACGCGGTCCCAGTTCAGAGACTGGGACCCAACAATGTCGGAATTCGAAATACGGTAAAACACATGCA GGAACGGCCAAGCTCATAGTGTTTACCGAATACCGGGACTCGCACGATTTGGAGGAGGTAAC AGGACGCCGCGAAGGTAGGATTGGGCGACTGGGGTGAAGCTGCCTAACACATGCAAGCGAACG |
| Clostridium_symbios um_WAL_14163_NCBI_ADLQ01000114 | Clostridium_symbi osum | ADLQ0100001 4 | SEQ ID NO: 198 | TTAAACATGAGACATGTGATCGGCTCAGGATGAACGCTGGCGGCGTGCCTAACACATGCAAGTCGAACGAAGCAATTT AACGGACAACAGTTTTTCGGATGATAGAGTGAATGACTGCTGAGAAGGTGAGTACCTGGCTTAACCTGCCTTGTACTG TACAAGATGGACGGCCACATTGGAACTGCGTCTGATTAGCTAGTTGGTAAGGTAACGGCTTACCAAGGCGACGATCAAGGT AGCCGACCTGAGAGGGTGACCGGCCACATTGGGACTGAGACACGGCCCAAACTCCTACGGGAGGCAGCAGTGGGGAATATTGCACATG GGAAGCCTGATGCAGCGACGCCGCGTGAGTGAAGAACCGGCCACAAGCAAAGTCTCATCAGCAGGGAAGACGAAATGACC CGGAGAAGCGAGACCAAGAGGCAGGCGTACGCGGGTAAACTCCGTAATGACGATTGACCCTTCTTACCGAACGCTCGCAAGACG TTACTGGGTGTAAAGGGAGCAGCTATGTGTCCGGTATGTCGAAGAAGTGAAATGCGTAAAGACAGTGTCACCAAGACCGCGCCGCTCTCCCT CGGAAACTGTTTAATCGAAGCAATTGACTGCCCTGTCGTTATCGAAGCAAGCAACCCAGCCGCCACCGGAGCG TGGGCGCAAGAAGACAAGGTCCCGGGAGTCGTGCCAGCCGGGCGTAAGAATCTCGAGATCAACGGCGATAAGTTCCGGAGGATGGCCGGCAA CAACCCTTATTCTAAGCTGGAACATGCCATATCATCATGGACGCCTACAACGTCGGAGTGCGCTAAACAGTCGAGCAGTGAACAACAGCAGCAGAAGCAGAGGCTCGGAGACAGAGTTGGAGTCGGAA GATGAGCTGAATCAAATCTCTAAGATAAGACGTCTCAGTTGGAATAACGTCCAGGGTTTCTAAAAGATAATACGGTCGCAAAGCAGCTGCAAGGAATGTGCCGGAGTTCG CTAGTAATCGCGAATCAGAATGTCGCGGTGAATACGTTCCCGGGCCTTGTACACACCGCCCGTCACACCACGAGAGTTGGGGA GTAACGCCCGAAGTCAGTGACCTAACCGTAAAGGGAAGCGGAGCTGCCGAAAGGGCGATAACTGGGGGTTGGGAATCGATTGATATA ACAAGGTAGCCGTATCGGGAAGGTGCGGCTGGGATCACCTCCTTTCT |
| Clostridium_symbios um_WAL_14673_NCBI_ADLR01000157 | Clostridium_symbi osum | ADLR01000157 | SEQ ID NO: 199 | TTTAAACATGAGACATGTGATCGGCTCAGGATGAACGCTGGCGGCGTGCCTAACACATGCAAGTCGAACGAAGCGAATTC ACGGACAAACAGTTAGAAAATGACTGCTAATGACAGTAATGACTGCTGAGAAGGTGAGTAACGCTGGGTAACCTGCCTTGTACTG GGGGACAACAGTTAGAAAATGACTGCTAATGACACGGTTAATGACAGCAGTATTAAAAATCCGGTGG TACAAGATGGACGGCCACATTGGGACTGAGACACGGCCCAGACTCCTACGGAGGCAGCAGTGGGGAATATTGCACAATGG GGGTGACCGGCCACATTGGGACTGAGACACGGCCCAAACTCCTACGGGAGGCAGCAGTGGGGAATATTGCACAATGG ACGTGACCGGCCACATTGGGACTGAGACACGGCCCAAACTCCTACGGGAGGCAGCAGTGGGGAATATTGCACAATGG ACGTACCCTGACTAAGAGGCAGCCGCCGCGGTAATACGTATGGTGCAAGCGTTATCCGGAATTACTGGGTGTAAAGGGCGCGTAGGCGGGA TTTACTGGGTGTAAAGGGAGCGTAGGCGGTAAGGCGGTGAAGTCGTGCTT |

FIG. 16AAAB

| | | | |
|---|---|---|---|
| Clostridium_viride_DSM_6836_NR_0262_04 | Clostridium_viride | NR_026204 | SEQ ID NO: 200 | GGAAACTGTTTAACTGGAGTGTGGGAGAAGAAGGTAAGTGGAATGGAATTCCTAGTGTAGCGGTGAAATGCGTAGAGATATTAGGAGGAA CACCAGTGGCGAAGGCGACCTTACTGGACGCAATAACTGACGTTGAGGCTCGAAAGCGTGGGGAGCAAACAGGATTAGATA CCCTGGTAGTCCACGCCGTAAACGATGAATACTAGGTGTTGGGGAGCAAAGCTCTTCGGTGCCGTCGCAAGCAGTAA GTATTCCACCTGGGGAGTACGTTCGCAAGAATGAAACTCAAAGGAATTGACGGGGACCCGCACAAGCGGTGGAGCATG TGGTTTAATTCGAAGCAACGCGAAGAACCTTACCAGGTCTTGACATCGTCTGACAATCCTAGAGATAGGGAAGTCCCTTCCTT CAACCCTTATTCTAAGTGTAGCGGTGTGCATGGTTGTCGTCAGCTCGTGTCGTGAGATGTTGGGTTAAGTCCCGCAACGAGCG CAACCCTTATCTATGATTAGCATTCAAAATAAACGTCTCAGTTCGACTGCCGTACACAGCCTACACCAAAGAGAAGAACAAGCGT GAGGTGAGCGCAATCATCAGATCAGATGCGGGAGAAACTCAAGGAGCGGAATCCCGAAAGATAAGCTCTAAGGCGTGGAGTCA GTAATACGCGGAATCAGAATGTCGCGGTGAATACGTTCCCGGGCCTTGTACACACCGCCCGTCAAGCCATGGGAGTTGGGAGT TAACGCGCGAAGGTATCGGATGACGAGGTACATCGCCCTTTCT | GATGAACGCTGGCGGCGTGCTTAACACATGCAAGTCGAACGAGACCATCTGGACAACAAGTTTCGACAAGGGAAGAT GTCGTTAGTGGCGGACGGGTGAGTAACACGTGAGCTAACCTGCCTTGGAGTGGGGAATAACAGATGGAAGGTGTCTAA ATACCGCATAATGCAACGGGATGCATCATCCGTTGCCCAAAGATTATGCGTCTGAGATGGGCTCGCGTCTGATTAGCT AGTTGGTGAGTAATGGCTCACCAAGGCGACGATCAGTAGCCGGACTGAGAGGTTGACCGGCCACATTGGGACTGAGA CACGGCCCAGACTCCTACGGGAGGCAGCAGTGGGGAATATTGCAATGGGCGAAAGCCTGATGCAGCAACGCCGCG TGAGGGAAGAAGGCCCTCGGGTTGTAACCTCTGTCGGGAGGGAAGATGACAGTACCTCCGAATAAGACCACG GCTAACTACGTGCCAGCAGCCGCGGTAATACGTAGGGGCCAAGCGTTATCCGGATTTACTGGGTGTAAAGGGCGTGTA GGCGGACTGCAAGTCAGATGTGAAATCCCAGGGCTCAACCTTGGGACTGCATTTGAAACTGTAGTCTTGAGTGATGG AGAGGCAGGCGGAATTCGGGGTGTAGCGGTGAAATGCGTAGATATTCCGAAGAACACCAGTGGCGAAGGCGGCCTGCT GGACATTAACTGACGCTGAGGCGCGAAAGCGTGGGGAGCAACAGGATTAGATACCCTGGTAGTCCACGCCGTAAACG ATGGATACTAGGTGTGGGGTGCCTGGACCTCAGTGCCGCAGTTAACACAATAAGTATCCACCTGGGGAGTACGATC GCAAGGTTGAAACTCAAAGGAATTGACGGGGGCCCGCACAAGCAGTGGAGTATGTGGTTTAATTCGAAGCAACGCGAA GAACCTTACCAGGGCTTGACATCCTTCTGACCGGCTTAGAGATAAGCGTTCCCTTCGGGGACAGAGGTGACAGGTGGTGC ATGGTTGTCGTCAGCTCGTGTCGTGAGATGTTGGGTTAAGTCCCGCAACGAGCGCAACCCTTACTGTTAGTTGCTACC ATTCGGGCACACTAGGCTACACGTACTACAATGGGGTCAATGGGGGCCGATATCCGCAAGGTAGAGCAAATGCGAATCCCAGC AAAGGACTCCCAGTTCCGGATTGCAGGCTGCAACTCGCCTACATGAAGTCGGAATTGCTAGTAATCGCGGATCAGCATGC CGCGGTGAATACGTTCCCGGGCCTTGTACACACCGCCCGTCAAGGCACGAAAGCTGGGAACACCCGAAGCCGGTGGC CCAAGTTCGCCAGTTCGGATTGAGAACCGCAAGGTGATGGTAACCGCGTAAGGATGCGGCTGAGGGTGAAGTCGTAACAAG GTAGCCGTATCGGAAGGTGC | |
| Collinsella_aerofaciens_ATCC_25986_NCBI_AAVN02000007 | Collinsella_aerofaciens | AAVN02000007 | SEQ ID NO: 201 | TTTGACGGAGAGTTCGATCCTGGCTCAGGATGAACGCTGGCGGCGTGCTTAACACATGCAAGTCGAACGGCACCGT CTCGCAGGAGTGCTCGAGGGTGAGTAACACGTGAGCAACCTGCCCCTGACTCTGGGATAACCCCCGGAAACGGGGC AGGACCGGGTAATACCGGATAACGACCGGGTGGCGCATCGCCACCGGTTAAAGGAGCAAAGGCTAAAGGCGGCCTCCG AGATTGGGACTGAGACACGGCCCAGACTCCTACGGGAGGCAGCAGTGGGGAATCTTGCGCAATGGGGGAAACCCTGA AGCAGCAACGCCGCGTGAGAGATGACGGCCTACGGGTTGTAAACCTCTTTCGGCAGGGACGAAGAAGGTTCAGTACCT GCGTAAAGCGCGCCGGTAACCGTGAAACCAGCCCCGGCTAACTACGTGCCAGCAGCCGCGGTAATACGTAGGGAGC AAGCGTTGTCCGGATTTACTGGGTGTAAAGGGGTGCGTAGGTGGCCCACGCAAGCCCGGAGTGTGGGGCAACGCATGG GTAGAAGCGCGCAACCGGGGAGTATCACTGGAGACCTTCAGATTAGAGGAAGGAGGGATGCGGCCGGTGCGAACCT GGTAGTCCCAGCCGTAAACGATGAACGATGTGGCGCGGAGACGCGGATCGCCTCCGCCCGCGCGCAAGCACGCGGAAGCCGGAG CCGCCTGGGAAGTATACCCGCAAGGGTGAAACTCAAAGGAATTGACGGGGGACCCGCACAAGCGGTGGAGCATGTGG CTTAATTCGAAGCAACGCGAAGAACCTTACCAAGGCTTGACATATGGCAGTATATGGAGAGATCCATACACAAGGTT CCACAAGGAGCAACCACAAGTGGTGCATGGTTGTCGTCAGCTCGTGTCGTGAGATGTTGGGTTAAGTCCCGCAACGAGCG CAACCCTTGTTGTCATGTTGCCATCAGGTCGGGCTGGGCACTCATGACAACACTGCCGACGACAAGTCGAGGAAGGTGG GGATGACGTCAAGTCATCATGCCCCTTATGTCCTGGGCTACACACGTGCTACAATGGCTGGTACAAAGGGCTGCAATACCG TGAGGTGGAGCCAATCCCTAAACCAGCCCCAGTTCAGATCGCAGGCTGAAACTCGCCTGCGTGAAGTCGGAATCGCTAGT AATCGCGGATCAGCATGCCGCGGTGAATACATTCCCGGGCCTTGTACACACCGCCCGTCAAGCACGAAAGCCGGGGAC GACCCGAAGGCGAGGCAGCGACCCCCCATGGCGCCAACGGGCGGGGCCAGCC GAGGGGAGGCAGCGGACCGCCGGAAGGGAAGGGGGGAGGCTGAAAGTCGAGTTG |

FIG. 16AAAC

| | | | | |
|---|---|---|---|---|
| | | | | CTAGTAATCGCGGATCAGCATGCCGCGGTGAATGCGTTCCCGGGCCTTGTACACACCGCCCGTCACACCACCCGAGTC<br>GTCTGCACCCGAAGTCGCCGGCCCAACCGAGAGGGGGGAGGCGCCGAAGGTGTGGAGGGTGAGGGGGGTGAAGTCG<br>TAACAAGGTAGCCGTACCGGAAGGTGCGGCTGGATCACCTCCTTTCT |
| Collinsella_intestinalis_DSM_13280_NCBI_ABXH02000037 | Collinsella_intestinalis | ABXH02000037 | SEQ ID NO: 202 | TTGGACGGAGAGTTCGATCCTGGCTCAGGATGAACGCTGGCGGCGCGCCTAACACATGCAAGTCGAACGGCACCCACC<br>CTCGGGTGGAAGCGAGTGGCGAACGGCTGAGTAACACGTGGAGAACCCGCCCCCTCCTCCGGGATAGCCTCGGGAAA<br>CCGTGGGTAATACCGGATGACCCCGCAGGGCCGCATGGCCCCGCGGGCAAAGCCCAGACGGGAGGGGATGGCTCCG<br>CGGCCCATCAGGTAGACGGCGGGGTGACGGCCCACCGTGCCGACGACGGGTAGCCGGGTTGAGAGACCGACCGGCC<br>AGATTGGGACTGAGACACGGCCCAGACTCCTACGGGAGGCAGCAGTGGGGAATCTTGCGCAATGGGGGGAACCCGTG<br>ACGCAGCGACGCCGCGTGCGGGACGAAGGCCCTCGGGTCGTAAACCGCTTTCAGCAGGGATGAGACAAGACGGTACC<br>TGCAGAAGAAGCCCCGGCTAACTACGTGCCAGCAGCCGCGGTAATACGTAGGGGGCGAGCGTTATCCGGATTCATTGG<br>GCGTAAAGCGCGCGTAGGCGGCCCGGCAGGCAGGGGGTCAAATGGCGGGGCTCAACCCCGTCGCGCCCCCTGAACC<br>GCCGGGCTCGGGTCCGGTAGGGGAGGGTGGAACACCCGGTGTAGCGGTGGAATGCGCAGATATCGGGTGGAACACC<br>GGTGGCGAAGGCGGCCCTCTGGGCCGAGACCGACGCTGAGGCGCGAAAGCTGGGGGAGCGAACAGGATTAGATACC<br>CTGGTAGTCCCAGCCGTAAACGATGGACGCTAGGTGTGGGGGGACGATCCCTCCGTGCCGCAGCCAACGCATTAAGCG<br>TCCCGCCTGGGGAGTACGGCCGCAAGGCTAAAACTCAAAGGAATTGACGGGGGCCCGCACAAGCAGCGGAGCATGTG<br>GCTTAATTCGAAGCAACGCGAAGAACCTTACCAGGGCTTGACATGACCGTGAAGCCGGGGAGACCCGGTGGCCGAGAG<br>GAGCGGTCACAGGTGGTGCATGGCTGTCGTCAGCTCGTGTCGTGAGATGTTTGGTTAAGTCCAGCAACGAGCGCAACC<br>CCCGCCGCCATGTTGCCAGCACCTCGGGTGGGGCACCCATGCGGGACCGCCGGAGTCAATCCGGAGGAGGGCGGGG<br>ACGACGTCAAGTCATCATGCCCCTTATGCCCTGGGCTGCACACGTGCTACAATGGCCGGTACAGCGGGATGCGATGGC<br>GCGAGCCGGAGCGGATCCCTGAAAGCCGGCCCCAGTTCGGATTGGGGGCTGCAACCCGCCCCCATGAAGTCGGAGTT<br>GCTAGTAATCGCGGATCAGCATGCCGCGGTGAATGCGTTCCCGGGCCTTGTACACACCGCCCGTCACACCACCCGAGT<br>CGTCTGCACCCGAAGTCGCCGGCCCAACCATCTGGGGGGAGGCGCCGAAGGTGTGGAGGGTGAGGGGGGTGAAGTC<br>GTAACAAGGTAGCCGTACGGGAACGTGCGGCTGGATCACCTCCTTTCT |
| Collinsella_stercoris_DSM_13279_NCBI_ABXJ01000150 | Collinsella_stercoris | ABXJ01000150 | SEQ ID NO: 203 | TTTGGACGGAGAGTTCGATCCTGGCTCAGGATGAACGCTGGCGGCGCGCCTAACACATGCAAGTCGAACGGCACCCGC<br>CCTCGGGCGGAAGCGAGTGGCGAACGGCTGAGTAACACGTGGAGAACCCGCCCCCTCCTCCGGGATAGCCTCGGGAA<br>ACCGTGGGTAATACCGGATGACCCCGGCAGGCCGCATGGCCGGCCGGGCAAAGCCCAGACGGGAGGGGATGGCTCC<br>GCGGCCCATCAGGTAGACGGCGGGGTGACGGCCCACCGTGCCGACGACGGGTAGCCGGGTTGAGAGACCGACCGGC<br>CAGATTGGGACTGAGACACGGCCCAGACTCCTACGGGAGGCAGCAGTGGGGAATCTTGCGCAATGGGGGGAACCCTG<br>ACGCAGCGACGCCGCGTGCGGGACGAAGGCCCTCGGGTCGTAAACCGCTTTCAGCAGGGATGAGACAAGACGGTACC<br>TGCAGAAGAAGCCCCGGCTAACTACGTGCCAGCAGCCGCGGTAATACGTAGGGGGCGAGCGTTATCCGGATTCATTGG<br>GCGTAAAGCGCGCGTAGGCGGCCCGGCAGGCAGGGGGTCAAATGGCGGGGCTCAACCCCGTCCCGCCCCCTGAACC<br>GCCGGGCTCGGGTCCGGTAGGGGAGGGTGGAACACCCGGTGTAGCGGTGGAATGCGCAGATATCGGGTGGAACACC<br>GGTGGCGAAGGCGGCCCTCTGGGCCGAGACCGACGCTGAGGCGCGAAAGCTGGGGGAGCGAACAGGATTAGATACC<br>CTGGTAGTCCCAGCCGTAAACGATGGACGCTAGGTGTGGGAGGGGAACCCTTCCGTGCCGCAGCCAACGCATTAAGCG<br>TCCCGCCTGGGGAGTACGGCCGCAAGGCTAAAACTCAAAGGAATTGACGGGGGCCCGCACAAGCAGCGGAGCATGTG<br>GCTTAATTCGAAGCAACGCGAAGAACCTTACCAGGGCTTGACATGCGCGTGAAGCCGGGGAGACCCGGTGGCCGAGA<br>GGAGCGCGCACAGGTGGTGCATGGCTGTCGTCAGCTCGTGTCGTGAGATGTTTGGTTAAGTCCAGCAACGAGCGCAAC<br>CCCCGCCGCATGTTGCCAGCACCTCGGGTGGGCACCCATGCGGGACCGCCGGAGTCAATCCGGAGGAGGGCGGGGA<br>CGACGTCAAGTCATCATGCCCCTTATGCCCTGGGCTGCACACGTGCTACAATGGCCGGTACAGCGGGATGCGATGGCG<br>CGAGCCGGAGCGGATCCCTGAAAGCCGGCCCCAGTTCGGATTGGGGGCTGCAACCCGCCCCCATGAAGTCGGAGTTG<br>CTAGTAATCGCGGATCAGCATGCCGCGGTGAATGCGTTCCCGGGCCTTGTACACACCGCCCGTCACACCACCCGAGTC<br>GTCTGCACCCGAAGTCGCCGGCCCAACCGAGAGGGGGGAGGCGCCTAAGGTGTGGAGGGTGAGGGGGGTGAAGTCG<br>TAACAAGGTAGCCGTACGGGAACGTGCGGCTGGATCACCTCCTTTCT |
| Collinsella_tanakaei_DSM_22478_NCBI_AB490807 | Collinsella_tanakaei | AB490807 | SEQ ID NO: 204 | TCATGGCTCAGGATGAACGCTGGCGGCGCGCCTAACACATGCAAGTCGAACGAGTGGCGAACGGCTGAGTAACACGTG<br>GAGAACCTGCCCCCTCCTCGGGGATAGCCGCGGGAAACCGCGGGTAACACCCGACGACCAAATGAGGGAGGGGATGG<br>CTCCGCGGCCCATCAGGTAGACGGCGGGGTAACGGCCCACCGTGCCGACAACGGGTAGCCGGGTTGAGAGACCGACC<br>GGCCAGATTGGGACTGAGACACGGCCCAGACTCCTACGGGAGGCAGCAGTGGGGAATCTTGCGCAATGGGGGCAACC<br>CTGACGCAGCGACGCCGCGTGCGGGACGAAGGCCTTCGGGTCGTAAACCGCTTTCAGCAGGGACGAAGACGGTACCT |

FIG. 16AAAD

| | | |
|---|---|---|
| Collinsella_tanakaei_YIT_12064_NCBI_AB490808 | Collinsella_tanakaei | AB490808 | SEQ ID NO: 205 | GCAGAGAAGCCCGGCTAACTACGTGCCAGCAGCCGCGGTAATACGTAGGGGCGAGCGTTATCCGGATTCATTGGG<br>CGTAAAGCGCGCGTAGGCGGCCCGGTTCGGTCGGATGTGAAATCCCGGGGCTCAACCCGGGAACACCGG<br>CGCGGCTGGTCCGGTGGAGGGTGAGAGGGGTGGAATTCCCGGTGTAGCGGTGAAATGCGTAGAGATCGGGAGG<br>TGGCGAAGGCGGCCCTCTGGACGACGTAGGCGAACACCTGGGGAGCGAAAGCGTGGGGAGCAACAGGATTAGATACCCTGGT<br>AGTCCCACGCCGTAAACGATGAGTGCTAAGTGTTGGGGGGCTTCCGCCCTTCAGTGCTGCAGCTAACGCATTAAGCACTCCGCCTGGG<br>GAGTACGGCCGCAAGGCTGAAACTCAAAGGAATTGACGGGGGCCCGCACAAGCAGCGGAGCATGTGGCTTAATTCGAA<br>GGTTAAGTCCCCGCGAACGAGCGCAACCCATGCCGTCAGCTCGTCGTCAGATGTTG<br>AGCCGGGATGGGGACGGGGACTCAAGTCATCATGCCCCTTATGCCTAGGGCTGCACACGTCTACAACCGCGTCA<br>CAACCCGCAGTCGTGCTGCACCGAAGCGTGCGGCTGGATCACCTCCT<br>CGTAACAAGGTAGCCGTATGGGAACGTGCGGCTGGAATCACCTCCT | 
| Coprobacillus_sp_D7_NCBI_ACDT01000199 | Coprobacillus_sp_D7 | ACDT01000199 | SEQ ID NO: 206 | GATGAACGCTGGCGGCGCGCCTAACACATGCAAGTCGAACGGAGTGGCGAACCTGCCGCGC<br>CCCTCCTCGGGATAGCGCGGGGTAACGCGGGATAACCCGGACAACCCGGGAAATGAGGGGATGGCTCCGCGC<br>CCATCAGTTAGAGACACGGCCCAACGGGGGGAATCTTGCGCAATGGACAGCCTGACGCAG<br>GGGACTGAGAGACACGGCCCAGACTCCTACGGGAGGCAGCAGTAGGGAATCTTCCGCAATGGACGGAAGTCTGACGAAGCAG<br>CGACGCCGTGCAAGAACGCTTTGGTCGGAAGAAAGCCCCTTTCAGTCAAACGAAGAAGATTAGCTAAGGTGTAAACGCGTTTCAGTTCGCGTTAAACGAAGAA<br>GCCCCGGCTAACTACGTGCCAGCAGCCGCGGTAATACGTAGGGGGGCAAGCGTTGTCCGGATTTATTGGG<br>CGTAGGGGCGCGTAGGCGGTTCAATAAGTCTGATGTGAAAGCCCGGGGCTCAACCCCGGAACTGCATCAGAAACTGTAAGAACTGGAGTGC<br>GGGAGAGGAGAGTGGAATTCCCTGTGTAGCGGTGAAATGCGTAGAGATAGGGAGGAACACCAGTGGCGAAGGCG<br>GCTCTCTGGCTCGACACTGACGCTGAGGCGCGAAAGCCAGGGGAGCAAACAGGATTAGATACCCTGGT<br>AGTCCTGGCCGTAAACGATGAATACTAGGTGTCGGGGGCTAAAGCCTTTCGGTGCCGCAGCAATGCGATAAGCATTCCGCCTGGG<br>GAGTACGACCGCAAGGGTTGAAACTCAAAGGAATTGACGGGGGCCCGCACAAGCGGTGGAGCATGTGGTTTAATTCGAAGCAACGCGA<br>AGAACCTTACCAGGTCTTGACATCCATTTAGGAAGCCCAAGAAGAAGAGTTAGCGTACAAGGATGGAT<br>CGGAGGAGGACGAACGTCAAGCTACATCGGCTGCAGGCCGGCGCCGCACAACGCGACACAGGAGGAGG<br>GTTGCTAGTTTATTCGGGACTGCCACTCCCAGAGGCTGCCCAAGATGCGGAAGAAGCTCACCAGGAGGAG<br>AGTGCGCCAAGGCTACCCAGTATCCCGGGAAC<br>GTAGCGCGTACGGGAAC | 
| Coprobacillus_sp_D7_NCBI_ACDT0100<br>0199 | Coprobacillus_sp_D7 | ACDT0100019 | SEQ ID NO: 206 | GAGAGTTTGATCCTGGCTCAGGATGAACGCTGGCGGCGTGCCTAATACATGCAAGTCGAACGAGCGACTTGTGCTCG<br>AGTAGCGAACGGGTAGTAATACATAAGTAACCTGCCCTAGAACAGGGGATAACTATTGGAAACGATAGCTAAGACCGCC<br>ATAAGGTACGACACTGCATGTGACACGGTATTAAAAGTGCCTCAAAGCACTGTAGGATGACTAATAAGCAATAAGTACTC<br>TGGTTGGCGCGGGGTAACGCCCACCAGGGACGATGCGTAGCCGACCTGAGAGGGTGAACCGCCACACTGGGACTGA<br>GACACGGCCCAGACTCCTACGGGAGGCAGCAGTAGGGAATCTTCGGCAATGGACGCAAGTCTGACCGAGCAACGCCG<br>CGTGAAGGAAGAAGACATTTCGGTATGTAAACTTCTGTTATAAAAGAAGAACAAACGTGTATAGAATCTTAGCGAGTG<br>ACGGTACTTTATTAGAAAGCCACGGCTAACTACGTGCCAGCAGCCGCGGTAATACGTAGGTGGCAAGCGTTATCCGGAA<br>TTATTGGGCGTAAAGCAGCTAGAGTGCAAGGAAGAGATGTGAAATTCCATGTGTAGCGGTGAAATGCCCAAATAGGAACAC<br>AAACCAGGCAGGTATCTGAAGTGCGAGATGCTGAGCTGCGTAGCTGGAGGCCCCAAAGTGTGGGTAGCAACAGGATTAGATACC<br>CTAGTGGTCCAACGCCGACACCTGATGAAACTAAGTGATGTTCAGTGCTGCAGTGACAAGCTAACGCAGTTCGGTATAAACCGACAGCCT<br>GCCTGAGTAGTACGTTCGCAAGAATGAAACTCAAAGGAATTGACGGGGACCCCGCACAAGCGGTGGAGCATGTGGTTT<br>AATTCGAAGCAACGCGAAGAACCTTACCAGGTCTTGACATACTCATAAAGCCCGCAGAGATGCGGGAAGCGCCGAATGCAG<br>ATACAGGTGGTGCATGGTTGTCGTCAGCTCGTGTCGTGAGATGTTGGGTTAAGTCCCGCAACGAGCGCAACCCCTTATCCG<br>TTAGTTACCATCATTAAGTTGGGCACTCTAGCGAGACTGCTACAATGGTTGGTACAATGAGGTGAGGTGAGCCGCGAGGTGAAGCGATG<br>ATCATGCCCCTATAAACCATTCTCAGTTCGGATTGTAGTCTGCAACTCGACTACATGAAGTTGGAATCGCTAGTAATCGCGAAT<br>AAACCCATAAACCATTCTCAGTTCGGATTGTAGTCTGCAACTCGACTACATGAAGTTGGAATCGCTAGTAATCGCGAAT |

FIG. 16AAAE

| | | | |
|---|---|---|---|
| Coprococcus_comes_ATCC_27758_NCBI_ABVR01000038 | Coprococcus_comes | ABVR01000003 8 | SEQ ID NO: 207 | CAGGCATGTCGCGGGTGAATACGTTCCCGGGCCTTGTACACACCGCCCGTCACACCACGAGAGTTTGATAACACCCGAAGC CGGTGGCCTAACCCTCGGGAAGGAGGAGTGTCTAAGGTGATTGGGGTGAAGTCGTAACAAGGTATCCCTAC GGGAACGTGGGATGATCAACCTCCTTTCTAAGGA GAGAGTTTGATCCTGGCTCAGGATGAACGCTGGCGGCGTGCTTAACACATGCAAGTCGAACGAAGCACTTAACCTGAT TCTTCGGATGAAGTTTTGTGACTGAGTGAGTGGCGAACGGGTGAGTAACGCGTGGGTAACCTGCCTCATACAGGGGGATA ACAGTTAGAAATGACTGCTAATACCGCATAAGACCACAGAGTCGCATGACTCAGTGGTGAAAACTCCGGTGGTATGAGA TGGACCCGCGTCTGATTAGCTAGTTGGTGAGGTAAGAGCCTACCAAGGCAACGATCAGTAGCCGACCTGAGAGGGTGA CCGGCCACACATTGGGACTGAGACACGGCCCAAACTCCTACGGGAGGCAGCAGTGGGGAATATTGCACAATGGGGGAAAC CCTGATGCAGCGACGCCGCGTGAGTGAAGAAGTATTCGGTATGTAAAGCTCTATCAGCAGGGAAGAAAATGACGGTAC CTGACTAAGAAGCACCGGCTAACTACGTGCCAGCAGCCGCGGTAATACGTAGGTGGCAAGCGTTATCCGGATTTACTGG GTGTAAAGGGAGCGTAGACGGCGTGTAAGTCAGTGAAGTCGTAGTCCCGGGTCAACCCGGGTGTGAAAGGGACTCGGG AAACTGGACTGCTTGAGAGTAGGAGAGGAAAGTGGAATTCCATGTGTAGCGGTGAAATGCGTAGATATATGGAGGAACA CCAGTGGCGAAGGCGGCTTTCTGGACTGTAACTGACACTGAGGCTCGAAAGCGTGGGGAGCAAACAGGATTAGATACCCTG GTAGTCCACGCCGTAAACGATGGATACTAGGTGTGGGAGGATTGACCCCTTCCGTGCCGCAGTTAACACAATAAGTATC CCACCTGGGGAGTACGTTCGCAAGAATGAAACTCAAAGGAATTGACGGGGACCCGCACAAGCGGTGGAGCATGTGGTTT AATTCGAAGCAACGCGAAGAACCTTACCAAGTCTTGACATCCCACTGACCGCTCCTAGAGATAGGAGTTCTTCTTCGGAAC AGTGGTGACAGGTGGTGCATGGTTGTCGTCAGCTCGTGTCGTGAGATGTTGGGTTAAGTCCCGCAACGAGCGCAACCC TTATCTTCAGTAGCCAGCAATTAAGTTGGGCACTCTGGAGAGACTGCCAGGGATAACCTGGAGGAAGGTGGGGATGACG TCAAATCATCATGCCCCTTATGATCTGGGCTACACACGTACTACAATGGCGTAAAACAAAGGGAAGCGACCTCGCGAG AGCAAGCAAATCTCAAAATAACGTCTCAGTTCGGATTGTAGTCTGCAACTCGACTACATGAAGCTGGAATCGCTAGTAA CGCGGATCAGCATGCCGCGGTGAATACGTTCCCGGGCCTTGTACACACCGCCCGTCACACCATGGGAGTTGGTAACG CCCGAAGTCAGTGACCTAACCGCAAGGAGGGAGCTGCCGAAGGTGGGACTGATAACTGGGGTGAAGTCGTAACAAGGT AGCCGTATCGGAAGGTGCGGCTGGATCAACACCTCCTTTCT |
| Coprococcus_eutactus_ATCC_27759_NCBI_EF031543 | Coprococcus_eutactus | EF031543 | SEQ ID NO: 208 | GATGAACGCTGGCGGCGTGCTTAACACATGCAAGTCGAACGATTGAAGCTTGCTTCAAGCTTGAGAGCTTGCTTGGCG GACGGGTGAGTAACGCGTGGGTAACCTGCCTCATACAGGGGGATAAGCAGTTGGAAACGACTGCTAAAACCGCATAAGC GCAACAGTATCGCATGATACAGCGTGAAAAACTCCGGTGGTATGAGATGGACCCGCGTCGTATTAGCTTAGTTGGTGAGG TAAGCGGCCCACCAAGGCGATGATACATAGCCGACCTGAGAGGGTGATCGGCCACATTGGGACTGAGACACGGCCCAA ACTCCTACGGGAGGCAGCAGTGGGGAATATTGCACAATGGGCGAAAGCCTGATGCAGCGACGCCGCGTGAGTGAAGAA GTATTTCGGTATGTAATCGCGTTATCAGCAGGGAAGAAGCACCGGCTAACTACGTGCCAGCAGCCGCGGTAATACGTAGGT GGCAAGCGTTGTCCGGATTTACTGGGTGTAAAGGGTGCGTAGGCGGTACAAGCAAGTCTGAAGTGAAATGTCGGGGCT CAACCCCGAGACTGCTTTGGAAACCGCTGTACTTGAGTGAAGTAGAGGCAAGCGGAATTCCTAGTGTAGCGGTGAAATG CGTAGATATTAGGAGGAACACCAGTGGCGAAGGCGGCTTGCTGGACTTTAACTGACGCTGATGCACGAAAGCGTGGGG AGCAAACAGGATTAGATACCCTGGTAGTCCACGCCGTAAACGATGAATGCTAGGTGTCAGGCCCTTTCCGGGACTGCAGC GTAGCGAAGCTAACGCATTAAGCATTCCGCCTGGGGAGTACGGCCGCAAGGTTGAAACTCAAAGGAATTGACGGGGG CCCGCACAAGCGGTGGAGCATGTGGTTTAATTCGAAGCAACGCGAAAAACCTTACCAAGTCTTGACATCCTCTTGACAGCT GTAGAGATACAGGTGTCCCTTCGGGGACAAGAGAGACAGGTGGTGCATGGTTGTCGTCAGCTCGTGTCGTGAGATGTTG GGTTAAGTCCCGCAACGAGCGCAACCCCTTATGTCCAGTTACCATCAAGTTGGGCACTCTGGACAGACTGCCGTCGCAA GACGGAGGAAGGTGGGGATGACGTCAAGTCATCATGCCCCTTATGCCCAGGGCTACACACGTGCTACAATGGCGTAAAC AAAGGGAGGCGAGACCGCGAGGTGGAGCCAATCCCAAAAAGTACGTCCCAGTTCGGATTGCAGTCTGCAACCGACTGC ACGAAGCTGGAATCGCTAGTAATCGCGGATCAGCATGCCGCGGTGAATACGTTCCCGGGCCTTGTACACACCGCCCGT CACACCATGGGAGTTGGGAATACCCGAAGTCAGTGACCTAACCGCAAGGAGGACGCCGCCGAAGGTAAGGCGGGCTAA GACACTGGGGTGAAGTCGTAACAAGGTAGCCGTATCGGAAGGTGCGGCTGGATCAACACCTCCTTTCT |
| Coriobacteriaceae_b acterium_phl_NCBI_JN837493 | Coriobacteriaceae_bacterium_phl | JN837493 | SEQ ID NO: 209 | GATCCTGGCTCAGGATGAACGCTGGCGGCGTGCTTAACACATGCAAGTCGAGCGGCCACCATGCTTCGGCAGGAAGCG AGCGGCGGACGGGTGAGTAACGCTGAGTAACACGTGCCCAACCTGCCCTCGGGACAGCCGCGGGAAACCGCTGATACC CGGTGGCCCCCCGGGGACGGCCTACAAACCGGGCATAGCTCCGGGATGGGGTCACCGGCGCTCAAGGCGGGGCATGGT AGTTGGTAGGGTAGCCGGCCGGAAGGCGATTAACCGGCCAAGGATGAGCTGAGAGGTTGGTCCAGGGCACTGGAACTG AGACACGGTCCAGACTCCTACGGGAGGCAGCAGTGGGGAATCTTGCGCAATGGGCGCAAGCCTGACGGAGCGACGCCG CGTGCGGGATGAAGGCCTTCGGGTTGTAAACCGCTTTCAGCAGGGACGAAGCGCAAGTGACGGTACCTGCAGAAGAAGC ACCGGCTAACTACGTGCCAGCAGCCGCGGTAATACGTAGGGTGCAAGCGTTGTCCGGAATTGGGGGGGGCATACCG |

FIG. 16AAAF

| | | | |
|---|---|---|---|
| Dorea_formicigenerans_ATCC_27755_NCBI_AAXA02000006 | Dorea_formicigenerans | AAXA02000006 | SEQ ID NO: 210 | GCTAACTACGTGCCAGCAGCCGCGGTAATACGTAGGGGGCGAGCGTTATCCGGATTCATTGGGCGTAAAGCGCGCGTAGGCGGAGGGCGGTGCAACGGCGGGGGTCAACCGGAATTGCGGTGGAATGCGGAGAGCTTGAGGTCGGCGCACCTGGGCCTCTGGGCGACGCTGAGGCGCGAAAGCTAGGGGAGCAACAGGATTAGATACCCCTGGTAGTCCCGCCCTAAACGATGACGACTAGGTGTGGGAGGTATGCAAGGTATTTCGACATCGCAGCAACGCGATAAGTCGTCCGCCTGGGGAGTACGGTCGCAAGATTAAAACTCAAAGGAATTGACGGGGGCCCGCACAAGCAGCGGAGCATGTGGCTTAATTCGAAGCAACGCGAAGAACCTTACCTGATCTTGACATCCCACTGACCGCTCCTTAATCGAGGAAGTCCCTTCGGGGCAGGTGGTGCACAGGTGGTGCATGGTTGTCGTCAGCTCGTGTCGTGAGATGTTGGGTTAAGTCCCGCAACGAGCGCAACCCCTATCGTTAGTTGCCAGCAGTTCGGCTGGGCACTCTAGCGAGACTGCCGGTGATAAACCGGAGGAAGGTGGGGATGACGTCAAATCATCATGCCCCTTATGATCTGGGCTACACACGTGCTACAATGGCGTAAACAAAGAGAAGCAAGACCGCGAGGTGGAGCAAAACTCATAAAAACGCGTCTCAGTTCGGATTGTAGGCTGCAACTCGCCTACATGAAGTCGGAATCGCTAGTAATCGCGAATCAGAATGTCGCGGTGAATACGTTCCCGGGCCTTGTACACACCGCCCGTCACACCATGGGAGTCGGAAACACCCGAAGTCGGTGAGGTAACCGGAAGGAGCCAGCCGCCTAAGGTGGGACAGATGATTGGGGTGAAGTCGTAACAAGGTAGCCGTA |
| Dorea_longicatena_DSM_13814_NCBI_AJ132843 | Dorea_longicatena | AJ132843 | SEQ ID NO: 211 | TAACGCGTGGGTAACCTGCCTCATACAGGGGATAAACAGTTAGAAATGACTGCTAATACCGCATAAGACCACAGCCCCCATGGAGGGGTGTTGAAAATCGCCTTTGGAGGCTTGAGCCTCATGCCCCGCATTGGTGAGACGCCCCTAATACAGGGCTAGCGCCGCACATTGACGGACCCGCGTCCGATTAGCTAGTAGGTGGGGTAATGCGCCTACCTAGGCGATGATCAGTAGCCGGTCTGAGAGGATGACCGGCCACACTGGGACTGAGACACGGCCCAGACTCCTACGGGAGGCAGCAGTGGGGAATATTGCACAATGGGCGAAAGCCTGATGCAGCAACGCCGCGTGAGTGATGAAGGCCTTCGGGTCGTAAAGCTCTGTCCTTGGGGAAGAACGCTAGAGGGAGTAACTGTCCCTCTGACGGTAGCCAAGGAGGAAGCCACGGCTAACTACGTGCCAGCAGCCGCGGTAATACGTAGGTGGCAAGCGTTGTCCGGATTTACTGGGTGTAAAGGGCGCGCAGGCGGAGCATTGAGCGCCACCGTGGCCCGCCTAGGGTGTGCCGCCCGCCGCCTATGGACTGCTAGAGCAGGCCGCCGTGCTTGGTGTTCTGTGATGACCGCAAAGCGTGGGGAGCAAACAGGATTAGATACCCTGGTAGTCCACGCCGTAAACGATGAATACTAGGTGTCGGGGAGCGAAAGCGCTTCGGCGCCGTAGCTAACGCATTAAGTATTCCGCCTGGGGAGTACGGCCGCAAGGTTGAAACTCAAAGGAATTGACGGGGGCCCGCACAAGCAGCGGAGCATGTGGTTTAATTCGAAGCAACGCGAAGAACCTTACCTACTCTTGACATCCCAATGAAGTTCAGAGATGGAACTTCGGTTCCCGCAAGGGAGATTGAGACAGGTGCTGCATGGCTGTCGTCAGCTCGTGTCGTGAGATGTTGGGTTAAGTCCCGCAACGAGCGCAACCCTTATCATCATGCCAGCAAATGGAAGACTGCCCGTGAGACTGCCGGTGATAAACCGGAGGAAGGTGGGGACGACGTCAAATCATCATGCCCCTTATGATCTGGGCTACACACGTGCTACAATGGCGTAAACAAAGGGAAGCGACCTCGCGAGAGCAAGCGGACCTCATAAAGTTGTCCTCAGTTCGGATCGTAGTCTGCAACTCGACTACGTGAAGCTGGAATCGCTAGTAATCGCAGATCAGAATGCTGCGGTGAATACGTTCCCGGGTCTTGTACACACCGCCCGTCACACCATGGGAGTCAGTAATGCCCGAAGTCAGTGACCTAACCGTAAGGAGGGAGCTGCCGAAGGTGGGACTGATGACTGGGGTGAAGTCGTAACAAGGTACCGTAC |

FIG. 16AAAG

| | | | |
|---|---|---|---|
| Eggerthella_sp._1_3_56FAA_NCBI_ACWN01000099 | Eggerthella_sp_1_3_56FAA | ACWN01000009 | SEQ ID NO: 212 | AATGGGCGTAAAACAAAGAGAAGCGAACTCGCGAGGGTAAGCAACAAATAACGTCTCAAAAATAAGCGTCTCAGTTCGGATTGTAGTCTG<br>CAACTGACTACATAGAAGCTGGAATCGGAATAATCGCAGTAATCAGAATGCTGCGGTGAATACGTTCCCGGGTCTTGTAC<br>ACACCGCCCGTCACACCATGGGAGTCATAAGCCGAAGTCAGTGACCCAACCGTAAGG<br>GAGAGTTTGATCCTGGCTCAGGATGAACGCTGGCGGCGTGCCTAACACATGCAAGTCGAACGATGAAGCCCCTCGG<br>GCGGACATGAAGTGGCGAACGGGTGAGTAACGCTGTCCTCCGGGACAACGGGATCGGAAAGCCGAAGAAGCCGCGCGA<br>GCTAATACCGGATACTCCCTCCCCGCTGACCAAACCTGCCCAATCGCCAGGGTCGGGCGGATAACGGCCACATTGG<br>ATTAGGTAGGCGGCCCACCTTGGCGATAGGTAGCCGGTCTGAGAGGATCGATCGACGACGGGCCAACTGGGCACACTGA<br>ACTGAGATACCGGCCAGACTCCTACGGGAGGCAGCAGTGGGGAATCTTGCGCAATGGGCGAAAGCCTGACGACGA<br>ACGCCGCGTGCGGGAAGACGACGGCCTTCGGGTTGTAAACCGCTTTCAGCAGGGGAGGAAGCGTTATCGGATTCATTGCCGATAAGA<br>AGCTCCGGCTAACTACGTGCCAGCAGCCGCGGTAATACGTAGGAGGCGAGCGTTATCCGGAATTACTGGGCGTAAAGA<br>GCGCGTAGGCGGCCCTCAAGCGGCTCTCAAGCCGAATCCGGCAGATATGGGGAGGCAGACTGGAAATCCCGAGAAGA<br>AGTTCGGCTAGAGGCGCCGCAACTGACCTGCATAGAGAGAACACCGGTGGAATCTGGAATCCGAGAACACGGGCGAAGG<br>CAGCTCCGCTGCGGCGAACCTTGACGCATAGCTGCGCCGCCCACAAGTGATGATGACTGGGGGCGAAAGCGGGGGA<br>CCGTAAACGATGATAACTGATGAGTGAGAGTGCGGGGGACTGATTCAAAATGTCAAAAGCCAACGCCAGCGTAGCTAG<br>GTACGGAGAACCCTTACCAGGCTGGTACGTAGTATCAAAGGCTTAAATGCCGGTGGGACTGATGGAGTGCCAGCAAGGTCA<br>CGGCACTAACGGGATGCTACCAGGACAATTCCGCGAAGAACGAAAAACCTTAAGGGAATTGACGGGGGCCCGCACAAGCGGTGGAGCATGGGGTTTAATTCGAAGCA<br>ACGCGAAGAACCTTACCAGGACTTGACATGTCAGAGCAATGGGACAGAGATGTCTCAGGGTCAGCAGAGGAGGAGCGCCACACAGGT<br>GGTGCATGCTGTCGTCAGCTCGTGTCGTGAGATGTTGGGTTAAGTCCCGCAACGAGCGCAACCCTTGTCCACTGTT<br>GCCAGCATTCAGTTGGGCACTCTAGTGGGACTGCCGGTGATAACCCCGAGGAAGGTGGGGATGACGTCAAGTCATCA<br>TGCCCTTTATGCTCCGGGCTGCACACGTGCTACAATGGCCGGTACAACGGGTTGCGAGTTGTGAGTCGAGAAGCCCAATCC<br>CTCAAAGCCGGTCCCAGTTCGGATTGCACTGTGCAAGGTGAATCGTCTAGTAATCGCGAATCAGAATGCTGCGGCAACGGTGATAGCGGAATCC<br>CCGGCCCCTTGTACACAACACCGCCCGTCAAGTCATGAAAAGAGGGAGTCGTCTAGATGGTGTCTGTAACCAGTGTAAGAAGCCG<br>AACCGAAGGTGCGGGCTGGATCCTTTCT |
| Eremococcus_coleocola_ACS_139_V_Col8_NCBI_AENN01000008 | Eremococcus_coleocola | AENN01000008 | SEQ ID NO: 213 | ATGAGAGTTTGATCTGGCTCAGGACGAACGCTGGCGGCGTGCCTAATACATGCAAGTCGAACGCACTGACGGAGAAC<br>TTGTTCTCTTAACGTGAGTGCGCGAACGCGTGAGTAACACGTGGGAAAACCTACCCCTTGAGCGGGGATAACGGTCGGAA<br>ACGATCGCTAATACCGCATAACGGCTTAATACCGCATGTGGTTGATTGAAAGATAAAGCCTTCGGCTTGCTATCACTCAAGGATGGCC<br>CACATTGGTGCATTAGCTAGTTGGTAGGGTAACGGCTTACCAAGGCAATGATGCATAGCCGACCTGAGAGGGTAATCGG<br>CCACACTGGGACTGAGACACGGCCCAGACTCCTACGGGAGGCAGCAGTAGGGAATCTTCCGCAATGGGCGAAAGCCTGA<br>CGGAGCAACGCCGCGTGTGTGAAGAAGGTTTTCGGATCGTAAAGCACTGTTATTAGGGAAGAACACCTGTAGTAGTAAC<br>TGGCTAGGATTGACGGTACCTAATGAGGAAGCCACGGCTAACTACGTGCCAGCAGCCGCGGTAATACGTAGGTGGCAA<br>GCGTTGTCCGGATTTATTGGGCGTAAAGGGAGCGCAGGCGGTGACTTAAGTCGTAATCAGAAATCCATGGGAAATCCGTA<br>GTGAAAGCCGAAGACAACCACGTGGTGAAGACGGCGGTCACAGTGATAGATTGGCCAGTCAGCGCCGAAAGCGTGGGGAGCAACACCGTGATAGAGGAGGCA<br>AACAGGATTAGATACCCTGGTAGTCCACGCCGTAAACGATGAGTGCTAAGTGTTGAGAGGTTTCCGCCCTTCAGTGCTG<br>CAGCTAACGCAATAAGCACTCCGCCTGGGGAGTACGACCGCAAGGTTGAAACTCAAAGGAATTGACGGGGACCCGCAC<br>AAGCGGTGGAGCATGTGGTTTAATTCGAAGCAACGCGAAGAACCTTACCAGGTCTTGACATCCTCTGACCGCCTCTAGAG<br>ATAGAGTTTTCTTCTTCGGAGCATAGAACAGGTGGTGCATGGCTGTCGTCAGCTCGTGTCGTGAGATGTTGGGTTAAGTC<br>CCGCAACGAGCGCAACCCTTATACAGTAGTTGCCAGCATCAGATTGGGCACTCTAGTGGGACTGCCGGTGACAAACCGGA<br>GGAAGGTGGGGATGACGTCAAATCATCATGCCCCTTATGACCTGGGCTACACACGTGCTACAATGGTCGGTACAACGAG<br>CAGCAACACTGCGAGGGGGAGCAAATCTCATAAAGCCGATCTCAGTTCGGATTGTAGTCTGCAACTCGACTACATGAAGCTGGAATCGCTAGTAATCGCGGATCAGCATGCCGCGGTGAATACGTTCCCGGGCCTGTACACACCGCCCGTCACACCATGGAAGCCGGGGCTTGTACACCAGGTGGGATAGTGATTGGGGTGA<br>AGTCGTAACAAGGTAGCCGTATCGGAAGGTGCGGCTGGATCACCTCCTTTCT |
| Erysipelotrichaceae_bacterium_3_1_53_NCBI_ACTJ01000113 | Erysipelotrichaceae_bacterium_3_1_53 | ACTJ01000113 | SEQ ID NO: 214 | TCAAATGAGAGTTTGATCCTGGCTCAGGATGAACGCTGACGGCATGCCTAATACATGCAAGTCGAACATGAAGTCTTAG<br>GAGCTTGCTCCAAAGAGACTTAGTGCGAACGGGTGAGTAACACGTAGGTAACCTGCCCATGTGTCTGGGATAACTGC<br>TGGAAACGGTAGCTAAAACGGGATAAGGTATACGGGCATGTACTGCTAGTTAAAGCACCCTGAAAGGTGTGAACATG<br>GATGAGACCTGCGGCGCATTAGCTAGTTGGTGAGGTAACGGCTCACCAAGGCGATGATGTATAGCCGACCTGAGAGGGTGAGCGGC<br>TAACACTGGGACTGAGACACGGCCCAAACTCCTACGGGAGGCAGCAGTAGGGAATTTTCGTCAATGGGGG |

FIG. 16AAAH

| | | | |
|---|---|---|---|
| Eubacterium_barkeri_NR_044661 | Eubacterium_barkeri | NR_044661 | SEQ ID NO: 215 | AACCCTGAACAGAGGAATGCCGCGTGAGTGATGAAGGAAGGTCTTCGGATCGTAAAGCTCTGTTGTAAAGTGAAGAACGGCTCAT AGAGGAAATGCTATGGAGTGACGGTAGCTTACCAGAAAGCCACGGCTAACTACGTGCCAGCAGCCGCGGTAATACGT AGGTGGCAAGCGTTATCCGGAATTCATTGGGCGTAAAGGGTGCGTAGGCGGTACTAAGTCTGTAGTAAAGGCAATG GCTCAACCATTGTAAGCTATGGAAGACCAGTGGCTAGAGTGCAGAAGAGGGCGATGGAATTCCATGTGTAGCGGTAAA TGCGTAGATATAGGAAGAACAACCCTAGTAGTGCACGCCGTAAACGATGAGAACTAAGTGTTGGAGGAATTCAGTGCTGCA GTTAACGCAATAAGTCTCCGCCTGGGGAGTATGCACGCAAGGTGTGCGAAGGCCTTAAACCGACGGGGGCCCGCACAA GCGGTGGAGTATGTGGTTTAATTCGAAGCAACGCGAAGAACCTTACCAGCACTTGACATCGCAAGGCTCAGAGA TAGAGAGATAATTATGGATCACAACGAAACCTTGTGCAGCCCTTATGGCGCTCAAATCAAGTGGGGACTCATGGCAGACTCCAACACATGC ACGAGCGCAACCCTGTCGCAGATCAAGTCGGGCACTAAAGGGGACTCATGCGGAGACTCCAACACATGGAGAG AGGGTGGGGATGACGTCAAATCATCATGCCCTTATGACCTGGGCTGCACACGTGCTACACACAATGCGTCAATTCATGAAGTCG GAATCGCTAGTAATCGCAGATCAGCATTGCTGCGGTGAATACGTTCCCGGGCCTTGTACACACCGCCCGTCAAACCATGG GAGTCAGTAATACCCGAAGCCAGTGGCCTAACCCGTAAGGAGGGAGCCGTCGAAGGTAGGACCGATGACTGGGGTTAAG TCGTAACAAGGTATCCCTACGGGAACGTGGGGATGGATCACCTCCTTCT |
| Eubacterium_callanderi_DSM_3662_NR_026330 | Eubacterium_callanderi | NR_026330 | SEQ ID NO: 216 | TTTAATTGAGAGTTTGATCCTGGCTCAGGACGAACGCTGGCGGCGTGCCTAACACATGCAAGTCGAACGAGAAGCTTTT ATGGATCCTTCGGGATGAAAATAAGAGTGGAAGCGTGAGTAACGCGTGGGTAACCTGCCTCATGACTGGGAAAGG AATAGCCTCCGGAAACGTGGGAGTAACACTGGAAACTGGTAGCTAATACCGCATGTGTTAATGAAAATCCGGCCATG AGATGGCCCCGCGTCCACTGGAAGTAGGTAGACAGCCCTACGGGAGGCAGCAGTGGGGAATATTGCGCAATGGGG CGAACGGTCACACTGGGCAGCAGAATACCGCGTGAGTGAAGAAGGTTTTCGGATCGTAAAGCTCTGTCCAGGAAGAAGTGA CAACGACCAATGAGAAGGGTCCGGCTAACTACGTGCCAGCAGCCGCGGTAAATACGTAGGGGGCAAGCGTTGTCCGGAA TTCACTGGGCGTAAAGGGCGCGTAGGCGGTTTTATAAGTCAGATGTGAAAGGCTACGGCTCAACCGTAGTAAGGCATTT GAAACTGTAAAGACTTGAGTGCTGGAGAGGCAAGCGGAATTCCTAGTGTAGCGGTGAAATGCGTAGAGATTAGGAAGAAC ACCGGTGGCGAAGGCGCTTGCTGGACCAATACTGACGCTGAGGCGCGAAAGCTAGGGGAGCAACAGGATTAGATA CCCTGGTAGTCCTAGCCGTAAACGATGATGACTAGGTGTTGGGAAAACTCAGTTGCCGCAGCTAACGCATTAAGTCATCC GCCTGGGGAGTACGACGCAAGGTTGAAACTCAAAGAATTGACGGGGACCCGCACAAGCGGTGGAGCATGTGGTTT AATTCGAAGCAACGCGAAGAACCTTACCAGGCCTTGACATCCTGGACAGAGATAGGAGATATTTCCTTCCTTGGACAAC CGGTGACAGGTGGTGCATGGTTGTCGTCAGCTCGTGTCGTGAGATGTTGGGTTAAGTCCCGCAACGAGCGCAACCCT ATTCGATAGTTACCAGCACTCAAAACCCTCTCTAGCGAGACTGCCGCGACAAGCGGAGGAAGGTGGGGATGACGTCAA ATCATCATGCCCCTTATGACCTGGGCTACACACACGTGCTACAATGGATGGTACAACGGGACGCGAAGGGAAGCGAGGAG GCCAAGCAAATCCCATAAAACCATTCCCAGTTCGGATTGCAGTCTGCAACTCGACTGCATGAAGTTGGAATCGCTAGTAA TCGCAGATCAGAATGCTGCGGTGAATACGTTCCCGGGCCTTGTACACACCGCCCGTCACACCATGAGAGTTGGCAACA CCCGAAGCCAGTGAGCGAACGGAAGNNNNNNNNNGATCACCTCCTTCT NNNNGTATCGGAAGNNNNNNNNNNGATCACCTCCTTCT CGAACGCTGGCGGCGTGCCTAACACATGCAAGTCGAACGAGAAGTTGAATGATCCTTCGGGGTGAATTAGAACTGG AAAGTGCCGAACGGGTAACGGTAAGCGTGGGTAACCTGCCTATGACGAGAAATAGCCTCGGGAAACGCTGGGAGTAAAAGC CTTATATATGGTTTGTCGCATAGCCAAAGATCATCGAAAATGCGTGGGTAACCCGGTCTCACACTGCATGAGAGGGCGAGA GGTGAGATAACACGCCCATCGGAGGAGGCAGCAGTGGGGAATATTGCGCAATGGGGGAAACCCTGACGCAGCAATACCGCGTGA GGTCCAGACTCCTACGGAGCAGCAGTGGGGAATATTGCGCAATGGGGGAAACCCTGACGCAGCAATACCGCGTGA GAAGAAGGTTCGGATGATGACCAAGGTCTCGGATGTGAAAATCCTGCAATGAAACATGAAAATCATGCCGGATAGGCTA ACTACGTGCCACACAGCCGCGGTAATACGTAGGGAGCAAGCGTTGTCCGGAATGTCCGGGCTTAAAGCGGTAGAGA GGCTATTGGGAATTCCTAAGCGCTGAGTGTGAAATCGTAACATGGCTTAGAACTGTGAGACTGGAGA GGCAAGCTAGAATTCCTAAGCGCTGAGTGTGAAATCGTAACATGGCTTAGAACTGTGAGACTGGAGA GGCAAGCGGAATTCCTAGTGTAGCGGTGAAATGCGGTAGATATTAGGAGGAACACCAGTGGCGAAGGCGGCTTGCTGGAGA AATCAAAGGAATTGACGGGGACCCGCACAAGCGGCGGAGCATGCGGAGCATGTGGTTTAATTCGAAGCAACGCGAAGAACCTTACCA GGTCTTGACATCCTCTGACAGAGATAGAGGAAGTTCCTCGGGAACAGAGAGACAGGTGGTGCATGGTTGTCGTCATGTGTCGT |

FIG. 16AAAI

| | | | |
|---|---|---|---|
| Eubacterium_contort um_DSM_3982T_clo ne_2_NCBI_FR7499 46 | Eubacterium_cont ortum | FR749946 | SEQ ID NO: 217 | CAGCTCGTCGTGTGAGATGTTGGGTTAAGTCCCGCAACGAGCGCAACCCCTGCCTTTAGTTGCCAGCATTAAGTTGGGC ACTCTAGAGGGACTGCCGGTGACAATACGGAGGAAGGTGGGGATGACGTCAAATCATCATGCCCCTTATGACCTGGGC TACACACGTGCTACAATGGTCGTTAACAGAGGGAAGCGAAGCCGCGAGGCGCAAGCAAATCTCAAAAACAATCCCAGTTC GGATTGCAGGCTGCAACTCGCCTGCATGAAGTTGGAGTTGCTAGTAATCGCGGATCAGAATGCCGCGGTGAATGCGTTC CCGGGTCTTGTACACACCGCCCGTCACACCATGGGAGTCAGTAATGCCCGAAGTCAGTGACCCGCAAGGACTCA CAGTGGGCGGATGGGGCTGAAGTCGTAACAAGGTAGCCGTATCGGAAGG |
| Eubacterium_dolichu m_DSM_3991_NCBI _L34682 | Eubacterium_dolic hum | L34682 | SEQ ID NO: 218 | TTTGATCCTGGCTCAGGATGAACGCTGGCGGCGTGCTTAACACATGCAAGTCGAGCGGAAGCACTTTACTTGATTTCTTC GGAATGAAAGTTTTGTGACTGAACGGCGTGCTTGGTGAGTAACGCGTGAGGAACCTGCCCATGTGCCCGGGATAAC TTAGAAATGACTGCTAATACCGGCATAAGCACCACAGTACGCATGTGCTGTGGTGCAAAAACTCCGGTGGTATGAGATGGA CCGCGTCTGATTAGCTAGTTGGTAAGGTAACGGCTTACCAAGGCGACGATCAGTAGCCGACCTGAGAGGGTGACCGG CCACATTGGGACTGAGACACGGCCCAAACTCCTACGGGAGGCAGCAGTGGGGAATATTGCACAATGGGGGAAACCCTG ATGCAGCGACGCCGCGTGGAGGATGAAGGTCTTCGGATTGTAAACTTCTATCAGGAGGAAGAAATGACGGTACCTGA CTAAGAAGCCCCGGCTAACTACGTGCCAGCAGCCGCGGTAATACGTAGGGGGCAAGCGTTATCCGGAATTATTGGGCGTG TAAAGGGAGCGTAGAGCGGTTCGGAAGTCTGAAGTGAAAACCCGGAGCTCAACTCCGGTATTGCATTGGAAACTGTTG AACTAGAGTGTCGGAGAGGTAAGTGGAATTCCTAGTGTAGCGGTGAAATGCGTAGATATAGGAGGAACACCAGTGGCGA AGGCGGCTTACTGGACGATGATACTGAGGCGCGAAAGCGTGGGGAGCAAACAGGATTAGATACCCTGGTAGTCC ACGCCGTAAACGATGAATACTAGGTGTCGGGTGCGAAAGCATTCCGTGCCGCAGCTAACGCAATAAGTATTCCACCTG GGGAGTACGTTCGCAAGAATGAAACTCAAAGGAATTGACGGGGACCCGCACAAGCGGTGGAGCATGTGGTTTAATTCG AAGCAACGCGAAGAACCTTACCAAGTCTTGACATCCCGATGACCGCTCTAGAGATAGAGCTTTCCTTCGGGACAGCGTGAC AGGTGGTGCATGGTTGTCGTCAGCTCGTGTCGTGAGATGTTGGGTTAAGTCCCGCAACGAGCGCAACCCTTATGCTTAGTT GCCAGCACTTCGGGTGGGAACTCTAAGGAGACTGCCGGGGATAACCCGGAGGAAGGTGGGGATGACGTCAAATCATCA TGCCCCTTATGACCTGGGCTACACACGTGCTACAATGGCTGGTACAACGAGTCGCAAGACCGCGAGGTGGAGCTAATCT CATAAAATCAGTCTCAGTTCGGATTGTAGTCTGCAACTCGACTACATGAAGCTGGAATCGCTAGTAATCGCGGAA TCAGAATGTCGCGGTGAATACGTTCCCGGGCCTTGTACACACCGCCCGTCACACCATGGGAGTCGGTAACGCCCGAAGT CAGTGACCCAACCGCAAGGAGGGAGCTGCCGAAGGTGAAGTCGTAACAAGGTAGCCGTATCGGAAGGTA TCGGAAGGTGCGGCTGGATCACCTCCTTCT |
| Eubacterium_fissicat ena_DSM_3598T_cl | Eubacterium_fissic atena | FR749935 | SEQ ID NO: 219 | TTTGATCCTGGCTCAGGATGAACGCTGGCGGCGTGCTTAACACATGCAAGTCGAGCGAAGCACTTTACTTTGATTTCTTC GGAATGAAAGAGTGTTGTGACTGAGCGGCGGACGGGTGAGTAACGCGTGGGTAACCTGCCTCATACAGGGGGATAACAG TTAGAAATGACTGCTAATACCGCATAAGCGCACAGTACCGCATGGTACAGTGCCAAAACTCCGGTGGTATGAGATGGA |

FIG. 16AAAJ

| | | | |
|---|---|---|---|
| one_1_NCBI_FR749935 | | | CCCGCGTCTGATTAGCTGAAGGTAAGCGTTACCAAGGCGACGATCAGTAGCCGACCTGAGAGGGTGACCGG<br>CCACATTGGGACTGAGACACGGCCCGGCACTCCTACGGGAGGCAGCAGTGGGGAATATTGCACAATGGGCGAAAGCCTG<br>ATGCAGCGACGCCGCGTGAAGGATGAAGGTATTTCGGTATGTAAACTTCTATCAGCAGGAAGAAAATGACGGTACCTGA<br>CTAAGAAGCCCCGGCTAACTACGTGCCAGCAGCCGCGGTAATACGTAGGGGGGCAAGCGTTATCCGGAATTACTGGGTG<br>TAAAGGGAGCTAGACGGTATGTGAAGTCTGATGTGAAAATGCGGGGCTCAACCCCGGGACTGCATTGGAAACTATGTA<br>ACTAGAGTGTCGGAGAGGATCAGTGGAATTCCTAGTGTAGCGGTGAAATGCGTAGATATTAGGAGGAACACCAGTGGCGA<br>AGGCGGCTTACTGGACGATCACTGACGGTTGAGGCGTGAAAGCGTGGGGACCATTCGGGACTGCAGCAACGCGAATAAGTATTCCACCTG<br>AGCGGTAAACGATGAATACTAGGTGTCGGGTGCCGTGCCCGCAGCAACGCAATAAGTATTCCACCTG<br>GGGAGTACGTTCGCAAGAATGAAACTCAAAGGAATTGACGGGACCCGCACAAGCGGTGGAGCATGTGGTTTAATTCG<br>AAGCAACGCGAAGAACCTTACCTGTCCTTGACATCCCACTGACGAGCCAGAGATGGTTCCTTCCCTTCGGGGCAGTGGA<br>TAGTAGCGACATGGTGCATGGTTGTCGTCAGCTCGTGTCGTGAGATGTTGGGTTAAGTCCCGCAACGAGCGCAACCCTTATCTT<br>CATCATGCCCCTTATGAGCAGGACTCACACGTGCTACAATGGCGTAAAACAAAGGAGCATGCCATACCGTGAGGTTGAGC<br>AAATCCCAAAAATAACGTCTCAGTTCGGATTGTAGTCTGCAACTCGACTACATGAAGCTGGAATCGCTAGTAACGCCAAGT<br>TCAGAATGCCGCGGTGAATACGTTCCCGGGCCTTGTACACACCGCCCGTCACACATGGGAGTTGTAACACCCGAAGT<br>CAGTGACCCAACCGTAAGGAGGGAGCTGCCGAAGGCGTAACTGATGACTGGG<br>CGGAAGGTGCGGCTGGATCACCTCCTT | SEQ ID NO: 220 |
| Eubacterium_hallii_DSM_3353_NCBI_ACEP01000116 | Eubacterium_hallii | ACEP01000011 6 | GGTGACTGAGTGGCGGACGGGTGAGTAACGCGTGGGGTAACCTGCCCTGCTACAGGGGATAACAGCTGGAAACGGCTG<br>CTAATACCGCATAAGCGCACAGGAGCGACATCCTGTGAAAACTCCGGTGGTACAGGATGGACTCCGCGTCTGATT<br>AGCTGGTTGGCAGGGTAACGGCCTACCAAGGCAACGATCAGTAGCCGGTCTGAGAGGATGAACGGCCACATTGGAACT<br>GAGACACGGTCCAAACTCCTACGGGAGGCAGCAGTGGGGAATATTGCACAATGGGGGAAACCCTGATGCAGCAACGCCG<br>CGTGAGTGAAGAAGTATTTCGGTATGTAAAGCTCTATCAGCAGGGAAGAAAATGACGTACCTGACTAAGAAGCTCCG<br>GCTAAATACGTGCCAGCAGCCGCGGTAATACGTATGGAGCAAGCGTTATCCGGATTTACTGGGTGTAAAGGGTGCGTAG<br>GTGGCAGTGCAAGTCAGATGTGAAATGCTACGGCTCAACCCGGCAGGGCGTGGATTGAAACTGCCTGCTAGAGTACAAGG<br>AGAGCAGGCGGAATTCCTAGTGTAGTCGTGAAATGCGTAGATATATAAAGAGGAACACCGCTGGCGAAGGCGGCCTGCT<br>GACTGTTACTGACACTGAGGCACGAAAGCGTGGGGAGCAAACAGGATTAGATACCCTGTATTCCACGCCGTAACG<br>ATGAATACTAGGTGTCGGGGGCGGGCGCTATAGCGCCCGTAAGCGAAGCGTTAAGGTATCTGGCCCACGTAATCCCACCGCCTGTG<br>GCAAGAATGAAACTCAAAGGAATTGACGGGACCCCGCACAAGCGGTGGAGCATGTGGTTTAATTCGAAGCAACGCGAA<br>GAACCTTACCAGGTCTTGACATCCTGCGACGTCTCCTTCCGGGAGGAAGAGAGAGAAACTTTAATCCTCAGTTACGCCAGCA<br>ATGGTTGTCGTCAGCTCGTGTCGTGAGATGTTGGGTTAAGTCCCGCAACGAGCGCAACCCCTATCTTCAGTTGCCAGCA<br>TTATGATCTGGCACTCTGGCAGGACTGCCTGTCATATGACCGGCGAGTGTGGGAGATGACCTGCATAACGCGAGAACGCGAA<br>AGCGGCGGCTCCAGTTCGGCACTCTATAGCTGCAACGCGGTCGTCAGTGAATGCCGCTAGTCAGTAATCGCGAAGTCG<br>GCGGTGAATACGTTCCCGGGTCTTGTACACACCGCCCGTCACACGCCGTAACAAGGTAGCCGTATCGGAAGGTGG<br>AACCCTTTGAGAGGCAGGCTGTCGACATCGCTTTCT | SEQ ID NO: 221 |
| Eubacterium_hallii_NCBI_L34621 | Eubacterium_hallii | L34621 | TGAGAGTTTGATCCTGGCTCAGGATGAACGCTGGCGGCGTGCCTAACACATGCAAGTCGAACGATGAAGTGAACATGAACGCATTACCWGA<br>TTCTGGATGAAAAGWYTGGTGACTGAGTGGCGGACGGGTGAGTAACGCGTGGGTAACCTGCCTGTACAGGGGGATA<br>ACAGTTGGAAACGACTGCTAATACCGGATAAGCCACATAGAGTGGAGATATCCTGTGAAACCGGGTACAGGA<br>TGGGCCCGCGTCTGATTAGCTGGTTGGCAGGGTAACGGCCTACCAAGGCGACGATCAGTAGCCGGTCTGAGAGGATGA<br>CCTGATGAACTGGAAACTGAGACACGGTCCAAACTCCTACGGGAGGCAGCAGTGGGGAATATTGCACAATGGGGGAAAC<br>CTGACTGAAGCAACGCCGCGTGAGTGAAGAAGTATTCGGTATGTAAAGCTCTATCAGCAGGGAAGAATAATGACGGTAC<br>CTGACTAAGAAGCCCCGGCTAAATACGTGCCAGCAGCCGCGGTAATACGTATGGAGCAAGCGTTATCCGGATTTACTGG<br>GTGTAAAGGGTGCGTAGGTGGCAGTGCAAGTCAGATGTGAAATGCCAGGGCTCAACCCTGGNGCTGCATTTGAAACTG<br>CWYRAGCTAGAGTACAGGAGAGGAAAGCGGAATTCCTAGTGTAGTCGTGAAATGCGTAGATATTAGGAGGAACACCAGT<br>GGCGAAGGCGGCTTTCTGGACTGTTACTGACACTGAGGCACGAAAGCGTGGGGAGCAAACAGGATTAGATACCCTGGT<br>AGTCCACGCCGTAAACGATGAATACTAGGTGTTGGGGAGCAAACACTCAAAGGAATTGACGGGACCCGCACAAGCGGTGGA<br>CACCTGGGGAGTACGTTACGCAAGAATGAAACTCAAAGGAATTGACGGGACCCGCACAAGCGGTGGAGCATGTGGTT | SEQ ID NO: 221 |

FIG. 16AAAK

| | | | |
|---|---|---|---|
| Eubacterium_limosum_DSM_20543_NCBI_CP002273 | Eubacterium_limosum | CP002273 | SEQ ID NO: 222 | AATTCGAAGNAACGCGAAGAACCTTACCAGGTCTTGACATCCTTCTGACCGCACCTTAATCGGTGCTTTCCTTCGGGACA GAAGAGACAGGTGGTGCATGGTTGTCGTCAGCTCGTGTCGTGAGAATGTTGGGTTAAGTCCCNCAACGAGCGNACCCC TATCTTCAGTAGCCAGCAGGAGTTAAGGCTGCCAGGCACTCTGGGCACTCTAGAGAGACTGCCAGGGATAACCTGGACAGGTGAGGCATGGATGG GTNNAATCATCACGAAGTGGCCCTTATGATCTGGGCATGGCGCAGGTACNATGGCGTACAACGGTTGGCACAAAGGCAAGGGGGACAGC GGGGAGCAANCCACAAAAAGGCCGTCCCAGTTCGGATACGTTCCCNNGTCTGAATACGTTCCCNNGTCACACCATGAAGCTGGAATCGCTAGT AATCGCGAATCAGAATGCCGACGGAGCCAGTGACCCAACCTTTATGACGAGGGAGCCTGTCGAAGGTGGAGCCGGTAACTGGG |
| | | | |
| | | | SEQ ID NO: 222 | AGAGTTTGATCCTGGCTCAGGACGAACGCTGGCGGTATGCTTAACACATGCAAGTCGAACGAGAAGGTTTTGAATGATC CTCGGGGTGAAATTAGAACTGGGAATTAGAAGCCGTGGGAACGGGTGAGTAACGCGTGGGTAACGCTGCCTATGGAAAGGAATAGC CTCGGGAAACTGGGAGTAAAGCCCTTATATATTGGTTTTGCGGATATCATGAAATCATGAAAAACTCCGGTGCATAGGATG GACCCGCGTCCATTAGCTAGTTGGTGAGATAAACAGCCCACCAAGGCCGACGATGGGTAACCGGTCTGAGAGGGCAACC GGTCACACTGGAACTGAGACACGGTCCAGATCTCCTACGGGAGGCAGCAGTGGGGAATATTGCGCAATGGGGCGAAAGCCTGACGCAGCAATACCGCGTGAGTGATGAAGGTCTGTTATTGGGGATCGTAAAGCTCTGTTATTCGGGAAGAACATGACGGTA CCCAATGGAGGAAGTTCCCGGCTCAGGGCTCTGGCTAATACGTAGCCCGCAAGGGCCCCGCAAGGGCCCCGCAAGGGCCCCGCAAGG CCAAGGACCAAGGATAGTGGGAATATCGTATAAGTCGAAGGTTACCGGCTCAACCGGTGAAGTGCATTGGAAAC TGGTAGACTTGAGTATTGGAGAGGCAAGTGGAATTCCTAGTGTAGCGGTGAAATGCGTAGATATATGGAGGAACACCAG TGGCGAAGGCGGCTTGCTGGACAAATACTGACGCTGAGGTGCGAAAGCGTGGGGAGCAACAGGATTAGATACCCTGG TAGTCCACGCCGTAAACGATGAATGCTAGGTTGTGGGGAAATCAGTGCCGCAGTTAACGCAGCTAACGCATTCCGCCTGG AGCAGTACGCAGCAAGAACCTTACAGGTCTTGACATCCTCCTAGAGATAAGAGAAGTTTCTTCGGAACAGAGAG ACAGGTGGTGCATTAAGTTGGGCACTCTGTGTCGTCAGCTCGTGTCGTGAGATGTTGGGTTAAGTCCGCAACGAGCGCAACCCCTGCCTT AGTTGCCAGCATTAAGTTGGGCACTCTGAAGAGACTGCCGGTGATAAACCGGAGGAAGGTGGGGATGACGTCAAATCAT CATGCCCCTTATGACCAGGGCTACACACGTGCTACAATGGTGTACAACAGAGGGCCCCGAAGCCGCGAGGTGAAGCAAA TCTCCAAAACAGATCCAGTTCGGATTGTAGGCTGCAACTCGCCTACATGAAGCCGGAGCCGAAGCACAACCCGAAGC AGAATGAGAAATCGCGTGAATACGTTCCCGGGTCTTGTACACACCGCCCGTCACACCATGGGAGTTGGAATGCCCG TGTGAGAGACGAAGGACTCAGCAACTCAGCTGAATGCACCAGGCCTAAGGTAACAAGGTAGCCGTAAACCAGTT GGAAGGTGCGGCTGGATCACCT |
| Eubacterium_rectale_ATCC_33656_NCBI_CP001107 | Eubacterium_rectale | CP001107 | SEQ ID NO: 223 | AGAGTTTGATCCTGGCTCAGGATGAACGCTGGCGGCGTGCTTAACACATGCAAGTCGAACGAAGCACTTTATTGATTTC CTTCGGGACTGATTATTTGTGACTGAGTGGCGGACGGGTGAGTAACGCGTGGGTAACCTGCCTTGTACAGGGGGATAA CAGTTGGAAACGACTGCTAATACCGCATAAGCGCACAGGACCCGCATGGTCCTGTGCCAAAACTCCGGTGTATAAGAT GGACCCGCGTTGGATTAGCTAGTTGGTGAGGTAACGGCCCACCAAGGCGACGATCCATAGCCGACCTGAGAGGGTGAC CGGCCACATTGGGACTGAGACACGGCCCAAACTCCTACGGGAGGCAGCAGTGGGGAATATTGCACAATGGGCGAAAGC CTGATGCAGCGACGCCGCGTGAGCGAAGAAGTATTTCGGTATGTAAAGCTCTATCAGCAGGGAAGATAATGACGGTACC CTGAGAAGAAGCACCGGCTAACTACGTGCCAGCAGCCGCGGTAATACGTAGGTGGCAAGCGTTATCCGGATTTACTGGG TGTAAAGGGAGCGCAGGCGGTGCAGCAAGTCTGATGTGAAAGCCCGGGGCTCAACCCCGGTACTGCATTGGAAACTGT CGTACTAGAGTGTCGGAGGGGTAAGCGGAATTCCTAGTGTAGCGGTGAAATGCGTAGATATTAGGAGGAACACCAGTG GCGAAGGCGGCTTACTGGACGATAACTGACGCTGAGGCTCGAAAGCGTGGGGAGCAAACAGGATTAGATACCCTGGTA GTCCACGCCGTAAACGATGAATACTAGGTGTTGGGGAGCAAGCATTCTCGGTGCCGCCCGCAAACGCAGCAGTATTCCA TTGAAGACAGGTGGTGCATGGTTGTCGTCAGCTCGTGTCGTGAGATGTTGGGTTAAGTCCCGCAACGAGCGCAACCCTT ATCCTTAGTAGCCAGCAGTTCGGCTGGGCACTCTAAGGAAACTGCCAGTGATAAACTGGAGGAAGGTGGGGATGACGT CAAATCATCATGCCCCTTATGACTTGGGCTACACACGTGCTACAATGCGTTGGGATAACAAAGGAAGCGAACCGCCCGC AGATGACAAGCCCAAATAACCTAGGCTCAGTTCAGATTGCAGGCTGCAACCCGCCTGCATGAAGCCGGAATTGCTAGTAATCGC AAGCCAGAATGCTTGCACCCCGTCTTACAAGGCTGCAACTCGCCTACATGAAGCCGGAATTGCTAGTAATCGC GTATCGGAAGGTGCGGCTGGATCACCT |

FIG. 16AAAL

| | | | |
|---|---|---|---|
| Eubacterium_rectale_DSM_17629_NCBI_FP929042 | Eubacterium_recta le | FP929042 | SEQ ID NO: 224 | TTTAACATGAGAGTTTGATCCTGGCTCAGGATGAACGCTGGCGGCGTGCTTAACACATGCAAGTCGAACGAAGCACTTT<br>ATTTGATTTCCTTCGGGACTGATTATTTTGTGACTGAAACGCTGAGTGACGGACGGGTGAGTAACGCGTGGGTAACCTGCCTTGTACA<br>GGGGGATAACAGTTGGAAACGACTGCTAATACCGCATAAGCGCACAGCATCGCATGATGCAGTGTGAAAAACTCCGGT<br>GGTATAAGATGGACCCGCGTTGGATTAGCTAGTTGGTGAGGTAACGGCCCACCAAGGCGACGATCCATAGCCGACCTG<br>AGAGGGTGACCGGCCACATTGGGACTGAGACACGGCCCAAACTCCTACGGGAGGCAGCAGTGGGGAATATTGCACAAT<br>GGGCGAAAGCCTGATGCAGCGACGCCGCGTGAGTGAAGAAGTATTCGGTATGTAAAGCTCTATCAGCAGGGAAGATA<br>ATGACGGTACCTGACTAAGAAGCACCGGCTAAATACGTGCCAGCAGCCGCGGTAATACGTATGGTGCAAGCGTTATCG<br>GATTTACTGGGCGTAAAGAGCATCGTAGGCGGCAATACAAGTCTGATGTGAAAAGCCCGGGCTCAACCCGGTGACTGCA<br>TTGGAAACTGTCTTGCTAGAGTGTCGGAGAGGTAAGCGGAATTCCTAGTGTAGCGGTGAAATGCGTAGATATTAGGAGG<br>AACACCAGTGGCGAAGGCGGCTTACTGGACGATAACTGACGCTGAGGAGCGAAAGCGTGGGGAGCAAACAGGATTAGA<br>TACCCTGGTAGTCCACGCCGTAAACGATGAATACTAGGTGTTGGGGAGCAAGCAGGAATTCTCTGTTTCCAGCCACCGCAGT<br>AACGCAGTTAATTGCAATACCAAGTTGACATCTCCTGGAGATGTCCTTTCGCAAGCGACATCTCTTTAAGGAACCAAACGGTACCTTCTCT<br>CGGAGCAGGGAGACAGTGGTGCATGGTTGTCGTCAGCTCGTGTCGTGAGATGTTGGGTTAAGTCCCGCAACGAGCGC<br>AACCCTATCTTTAGTAGCCAGCAGCCCTTAAGGGACTGCTACACGTGCTACAATGGCGTACAATGGCGTACACAACG<br>GATGACGTCAAATCATCAAAAATAACGTCTCAGTTCGGATTGTAGTCTGCAACCCGACTACATCACGAAGCTGGAATCGC<br>TAGTAATCGCAGATCAGAATGCTGCGGTGAATACGTTCCCGGGCCCTTGTACACACCGCCCGTCACAACCATGGGAGTTGG<br>GAATACCCGAAGTCCGTAACCTAACCGCAAGGAGGCAGCCGTAAATACTCGGAAGGGTGATCACCT<br>AAGGTAGCCGTATCGGAAGGTGCGGCTGGATCACCT |
| Eubacterium_rectale_M104_1_NCBI_FP929043 | Eubacterium_recta le | FP929043 | SEQ ID NO: 225 | AGAGTTTGATCCTGGCTCAGGATGAACGCTGCTTAACACATGCAAGTCGAACGAAGCACTTTATTGATTTC<br>CTTCGGGACTGATTATTTTGTGACTGAAACGCTGAGTGACGGACGGGTGAGTAACGCGTGGGTAACCTGCCTTGTACAGGGGGATAAC<br>AGTTGGAAACGACTGCTAATACCGCATAAGCGCACAGCATCGCATGATGCAGTGTGAAAAACTCCGGTGGTATAAGAT<br>GGACCCGCGTTGGATTAGCTAGTTGGTGAGGTAACGGCCCACCAAGGCGACGATCCATAGCCGACCTGAGAGGGTGAC<br>CGGCCACATTGGGACTGAGACACGGCCCAAACTCCTACGGGAGGCAGCAGTGGGGAATATTGCACAATGGGCGAAAGC<br>CTGATGCAGCGACGCCGCGTGAGTGAAGAAGTATTCGGTATGTAAAGCTCTATCAGCAGGGAAGATAATGACGGTACC<br>TGACTAAGAAGCACCGGCTAAATACGTGCCAGCAGCCGCGGTAATACGTATGGTGCAAGCGTTATCGGATTTACTGGG<br>CGTAAAGGGCACGTAGGCGGCTTACTGGCGTAAGCGGAATGCGAAGGCTCAACCAGGGCAAATGCATTGAAACTGTCTAGCTAGCTAGAG<br>GCGAAGGCGCGCGCGTAAACGATGAATACTAGGTGTTCGTCGGCGCGTCAACGATGTAGAGCGGCAGCATTTACAAGGAAAAAAAAAAG<br>CCTCACGCGAAGCAGGGGAGCGTGAAGAAAGTATTGACGGCGACCGCACAAGCGGTGGAGCATGTGGTTTAATTCCGA<br>TGCAAGACCGAGGATCCGCGCAGGTAACATCATCATCCAAGTGGAGGAAGACTGTACTCGTTGCAATACCATACCGCAAACCAT<br>AGTCAGGTCATGAGGTTCCAGGGGCGAAGGGAACATCGTCGTCAAGCTCGTGTCGTGAGATGTTGGGTTAAGTCCCGCA<br>CTTTAGTAGCCAGCAGCACTCTAGGGGACTGCTACACGTGCTACAATGGCGTAAACAAAAGGAAGCGAAACCGCGAGG<br>AAATCATCATCATCAAAAATAACGTCTCAGTTCGGATTGTAGTCTGCAACCCGACTACATGAAGCTGGAATCGCATCGG<br>TGTAAGGGCAGAATGCTTCGGCGGTGAATACGTTCCCGGGTCCTTGTACACACCGCCCGTCACACACACATGGGAGTGG<br>AGATCAGAATGCTGCGGTGAATACGTTCCCGGGTCCTTGTACACACCGCCCGTAATCACACACCATGGGAGTGG<br>AAGCCGTAACCTAACCGGAAGGAGCGCGCCGTAACCTAACCGCAAGGAGGCAGCCGTAAAATCTCGAAAGCTCGTAACAAGGTAGCC<br>GTATCGGAAGGTGCGGCTGGATCACCT |
| Eubacterium_rectale_S2S2_7_NCBI_AY804151 | Eubacterium_recta le | AY804151 | SEQ ID NO: 226 | AGTTTGATCCTGGCTCAGGATGAACGCTGCTTAACACATGCAAGTCGAACGAAGCACTTCTATGATT<br>CTTCGGGACTGATTATTTTGTGACTGGGACGGGTGAGTAACGCGTGGGTAACCTGCCTTGTACAGGGGAT<br>AACAGTTGGAAACGACTGCTAATACCGCATGATGCAGTGTGAAAAACTCCGGTGGTATAAG<br>ATGGACCCGCGTTGGATTAGCTAGTTGGTGAGGTAACGGCCCACCAAGGCGACGATCCATAGCCGACCTGAGAGGGTG<br>ACCGGCCACATTGGGACTGAGACACGGCCCAAACTCCTACGGGAGGCAGCAGTGGGGAATATTGCACAATGGGCGAAA<br>GCCTGATGCAGCGACGCCGCGTGAGCGAAGAAGTATCAGCAGGGTAATACGCAGGATATCCGGTTATCAGGCAGGCAGG<br>CGTAAAGGGCGTGTAGGCGGCTGATTGTGAGATGTGAAAGCCCACGGCTCAACCGTGGAGGCGTCATTACGAACTGA<br>GGTGGTAAGGGAGCAGCCGGAATTCCCGCAGTAGCGGTGAAATGCGTAGATATCCGGAAGAACACCAGTGGCGAAGGC<br>GGCTGCTCTGGGACTGTAACTGACGCTGAGACGCGAAAGCGTGGGGAGCAAACAGGATTAGATACCCTGGTAGTCCAC<br>GCCGTAACGATGATTACTAGGTGTAAGGGATGAAAGCTCACCGCTGGCGTCGGGCTAAATACGCCGTCAAGTCGACCG<br>CCTGGGGAGTACGGCCGCAAGGCTAAAACTCAAAGGAATTGACGGGACCCGCACAAGCGGTGGAGTATGTGGTTTAATTCGA<br>AGCAACGCGAAGAACCTTACCAAGTCTTGACATCCCGATGACCGCAGTAGAAATACTGTTTCCCTTCGGGGACATCGGT<br>GACAGGTGGTGCATGGTTGTCGTCAGCTCGTGTCGTGAGATGTTGGGTTAAGTCCCGCAACGAGCGCAACCCTTATTG<br>CCAGTTACCAGCAGGTAAAGCTGGGCACTCTGGTGAGACTGCCAGGGATAACCTGGAGGAAGGTGGGGATGACGTCAAA<br>TCATCATGCCCCTTATGACCTGGGCTACACACGTGCTACAATGGCGTAAACAAAGGGAAGCGAGACAGTGATGTGGAGCAAA<br>ACTCAAAAAGTACGTCTCAGTTCGGATTGCAGGCTGCAACTCGCCTGCATGAAGTCGGAATTGCTAGTAATCGCAG<br>ATCAGAATGCTGCGGTGAATACGTTCCCGGGTCCTTGTACACACCGCCCGTCACACCATGGGAGTCAGTAATGCCCG<br>AAGTCAGTGAGCTAACCGCAAGGGAGCCAGCCGCCGAAGGTGGGACTGATGACTGGGGTGAAGTCGTAACAAGGTAGCC<br>GGTGTAAGGGGCCAGGCTGGATCTATACGGCTCAACCCCGGCTCAACCCCGGGGCTCAACCTAGTAGGGTGAAATGCAAGCTGAAATGCAATGAAGCATTGGAAAC |

FIG. 16AAAM

| | | | |
|---|---|---|---|
| Eubacterium_sp_3_1_31_NCBI_ACTL01000045 | Eubacterium_sp_3_1_31 | ACTL01000045 | SEQ ID NO: 227 | TGTCGTACTAGAGTGTCGGAGGGGGTAAGCGGAATTCCTAGTGTAGCGGTGAAATGCGTAGATATTAGGAGGAACACCAG TGGCGAAGGCGGCCTTACTGGACGATAACTGACGCTGAGGCTCGAAAGCGTGGGGAGCAACAGGATTAGATACCCTGG TAGTCCACGCCGTAAACGATGAATACTAGGTGTTGGGGAGTATGACCCTCTCCGTGCCGTCGCAAACGCAGTAAGTATTC CACCTGGGGAGTACGTTCGCAAGAATGAAACTCAAAGGAATTGACGGGGACCCGCACAAGCGGTGGAGCATGTGGTT AATTCGAAGCAACGCGAAGAACCTTACCAAGTCTTGACATCCTTCTGACAGAGCTAGAGATAGCTCTTCCCTTCGGAGCA GGAGTGACAGGTGGTGCATGGTTGTCGTCAGCTCGTGTCGTGAGATGTTGGGTTAAGTCCCGCAACGAGCGCAACCCT TATCTTAGTAGCCAGCATTCAGCTGGGCACTCTAGGGAGACTGCCAGGGATAACCTGGAGGAAGGCGGGGATGACG TCAAATCATCATGCCCCTTATGACTTGGGCTACACACGTGCTACAATGGCGTAAACAAAGAGAAGCAAGACCGTGAGG CGAGCAAATCTCAAAATAACGTCTCAGTTCGGATTGTAGTCTGCAACTCGACTACATGAAGCTGGAATCGCTAGTAATC GCAGATCAGAATGCTGCGGTGAATACGTTCCCGGGTCTTGTACACACCGCCCGTCACACCATGGGAGTTGGGAATGCC CGAAGTCAGTGACCTAACCGCAAGGAGGACGGCGCCGAAGGTGGGACTGATAACTGGGGTGAAGTCGTAACAAGGTAG CCGT |
| Eubacterium_sp_oral_clone_GI038_NCBI_AY349374 | Eubacterium_sp_oral_clone_GI038 | AY349374 | SEQ ID NO: 228 | AGAGTTTGATCCTGGCTCAGGATGAACGCTGGCGGCGTGCCTAATACATGCAAGTCGAACGAAGTCTTAGGAAGCTTG CTTCCAAAGAGACTTAGTGGCGAACGGGTGAGTAACACGTGAGTAACCTGCCCATGTGCCCGGGATAACTGCTGGAAAC GGTAGCTAAAACCGGATAGTTGGTGAGGGAGCATCTTCCTCATATTAAAAGCACCTTCGGGTGTGAACATGGATGGACCT GCGGCGCATTAGCTAGTTGGTGAGGTAACGGCTCACCAAGGCGACGATGCGTAGCCGACCTGAGAGGGTGAACGGCC ACATTGGGACTGAGACACGGCCCAAACTCCTACGGGAGGCAGCAGTGGGGAATATTGCGCAATGGGGGAAACCCTGAA CGAGCAATGCCGCGTGTGTGAAGAAGGTCTTCGGATCGTAAAGCACTGTCTTAAGGGAAGAACACGTGCCACATAGAAAT GCTATGTGGGTGACGGTAGCTTACCAGAAAGCCACGGCTAACTACGTGCCAGCAGCCGCGGTAATACGTAGGTGGCAA GCGTTATCCGGAATCATTGGGCGTAAAGCGTGTGTAGGCGGTTCTTTAAGTCAGAGGTTAAAGGCAAGAGCTCAACTCT TGTAAGCCTTTGAAACCGGAAGACTTGAGTGAGGTAGAGGTAGAGGTGTGTGGAATTCCTAGTGTAGCGGTGAAATGCGTAGATAGC TGGAGGAACACCAGTGGCGAAGGCGGCTCTACTGGACCTGTAACTGACGCTGAGGCACGAAAGCGTGGGGAGCAACAG GATTAGATACCCTGGTAGTCCACGCCGTAAACGATGAGTGCTAGGTGTAAGGGGACTCGAGTTCCCTTGTGCCGCAGCT AACGCAATAAGCACTCCGCCTGGGGAGTACGTTCGCAAGAATGAAACTCAAAGGAATTGACGGGGGCCCGCACAAGCGGT GGAGCATGTGGTTTAATTCGACATGATAAATCTTCTAGAGATAGAGAAGACTGCCAACGGTGCTGACATCGGCCCGAAGCG AAGGTCAGATGAACTTCTCAGAGTCCTTACGGGACACAGGTGCATGGTGAGACCAACGGTCATGCACAAAACCGACACAAG CCAATGATGGGGCGCTACACGCATGCAAGGATCAAAGCGGAGAAGAGATAACAGGGGAGTAACGGGGAGGGTAATACCA GAAGCCAGGAATTAGGGGCTAATACGCAAGGCAAGCAGGCAAGGCAATGCACACAAAAGCTCCACCAAGCGGGCTAACCCAAA CGGTTCATCAGCCAATGCAAGCAACATGTGGCGGGAATACAGGTGCGCGCCGCGCAACCTCCAACACGCCCGTGCACACACACCGCCC GTCAGATCACCTCCGGGGAGCCGAAGTGCGCAAAAGTGGGCCAAGTGAACGAGAAAAAGTGGTAT ACGCGTGGGAGCCCGCAGGGCAACCTGCCGTCGGATTAGAATCACCGACGGTGGGCCCATAAGCGACCGGCCGAGAG GGCCGACGGCCACCGTCCACACTTGGCGAGCAGCGCAGCCGAGTGAGGAACACCGGGACCGTATATACTCAGCGGGTCAGCAGCGGG AGGCCCTGCACACCCGCAAATGTTGAGGGTGACGGGGCGGTGAACCGTCTATAGAGACACGGGCGTTTATCCGGATTTAC CACTTATGAGACAAGCGAGTATCGGAGGCGGCCGGAAGGCCACCTCGGTGATGCACCGAGTGAGCACCTTGCTTTGGGAA CGGGGAAATCGGGACAACGCCCCAAGCATGAGACCAAAGTGATAGTTCCACCTGGGAGCAAATGCCTTACCCGGACGG TACCCCACAACCGCGGTAATAGCGGAGGTGGCAGCAGCCGCGGTAATACGCGAGGGTGATAAGCGTTGTCCGGAATTAC TGGGCGTAAAGAGCTCGTAGGCGGCTAAGCCAAGCGATGAAGCTACACACGATCCAAAGGTGATCATGCGCCGGTGCATAAGCTCGGA AGTACGTTCGCAAGAATGAAATCCAGAGCTCAACTCTGGGAACTGCTTGGATACAGGTGCTAGATACACACGGGATTAC AAGGCGGAAGGTGGCGGTGAACCGTCCGGGGGCTTATACGAGAAGCGGGAAATCGTTCCAGCCATGAGTATCGAGCCCAGTCCTAACACCAGCGCCGGCTAACACCTCTGAACCAGCTTATATCGACAGCCGCCGAAGCCACCGCACTGGAGC AGCGCCGGCCCATCCAGGTCTAACGCTCCCATGTGCGGTCATGCGCCGCCGGAATTCCAAGGCCCAAGTCCCAGCGAG TCGCTAGTAATCGCGGATCAGCATGCCGCGGTGAATACGTTCCCGGGCCTTGTACACACCGCCCGTCACACCATGGGAG |

FIG. 16AAAN

| | | | | |
|---|---|---|---|---|
| | | | | TCGGGAATGCCCGAAGCCGGTACCTAAGGAGCCGTCGAAGGCAGGCCGGATGACTGGGGTGAAGTCGTAACAAGGTAGCCGTAGGAGAACCTGCGGCTGGAACACCTCCTT |
| Eubacterium_sp_WAL_14571_NCBI_FJ687606 | Eubacterium_sp_WAL_14571 | FJ687606 | SEQ ID NO: 229 | TAGAAGTTTGTATTTCTGCTCAGGATGACGCTGGCGGCGTGCTTAACACATGCAAGTTCGAGCGAGAAGCCCATTGACTGAAACCTTCCGGTAGAAGGGATTATGGTGGAAAGCGGCGGACGGGGTGAGTAACGCGTAGCCAACTTGCCCTTTACAGAGGGATAGCCATTGGAAACGATGATTAAAACCTCATAACGCTCCCCCYCACATGGAGGGGAAGCCAAAGATTCATCGGTAAGGGATGGGCCTGCGTCTGATTAGCTTGTTGGCGGGGTAACGGCCCACCAAGGCGACGATCAGTAGCCGACCTGAGAGGGTGATCGGCCACATTGGAACTGAGACACGGTCCAAACTCCTACGGGAGGCAGCAGTGGGGAATATTGCACAATGGGCGAAAGCCTGATGCAGCAACGCCGCGTGAGGGATGAAGGCCTTCGGGTCGTAAACCTCTGTCCTTGGGGAAGAAACAAATGACGGTACCCATGGAGGAAGCCCCGGCTAACTACGTGCCAGCAGCCGCGGTAATACGTAGGGGGCGAGCGTTATCCGGAATTATTGGGCGTAAAGAGTGCGTAGGTGGTTACCTAAGCGCAGGGTCTAAGGCAATGGCTCAACCATTGTTCGCCCTGCGAACTGGGCTACTTGAGTGCAGGAGAGGAAAGCGGAATTCCTAGTGTAGCGGTGAAATGCGTAGATATTAGGAGGAACACCAGTGGCGAAGGCGGCTTTCTGGACTGTTACTGACACTGAGGCACGAAAGCGTGGGGAGCAAACAGGATTAGATACCCTGGTAGTCCACGCCGTAAACGATGAGCACTAGGTGTCGGGGCCGCAAGGCTTCGGTGCCGCAGTTAACGCATTAAGTGCTCCGCCTGGGGAGTACGCACGCAAGTGTGAAACTCAAAGGAATTGACGGGGACCCGCACAAGCAGCGGAGCATGTGGTTTAATTCGAAGCAACGCGAAGAACCTTACCAGGACTTGACATCCCACTGACAGATCCCTAACCGGATCCTTCTTCGGACAGTGGAGACAGGTGGTGCATGGTTGTCGTCAGCTCGTGTCGTGAGATGTTGGGTTAAGTCCCGCAACGAGCGCAACCCTTGCCATTAGTTGCCATCATTCAGTTGGGCACTCTAATGGGACTGCCGGGGACAACTCGGAGGAAGGTGGGGATGACGTCAAATCATCATGCCCCTTATGTTCTGGGCTACACACGTGCTACAATGGCCGGTACAGCAAGAAGCAAAACCGCGAGGTGGAGCAAATCTCAAAAACCGGTCCCAGTTCGGACTGCAGGCTGAAACCCGCCTGCACGAAGCCGGAGTTGCTAGTAATCGTGGATCAGAATGCCACGGTGAATGCGTTCCCGGGTCTTGTACACACCGCCCGTCACACCATGGAAGTTGGGGGTGCCCGAAGCCGGCAGGGAAATATGCTGTCTAAGGCAAAACCAATGACTGGGGTGAAGTCGTAACAAGGTTAACCGTAAA |
| Eubacterium_tenue_NCBI_M59118 | Eubacterium_tenue | M59118 | SEQ ID NO: 230 | TTTTATTTGAGAGTTTGATCCTGGCTCAGGATNAACGCTGGCGGCGTGCCTAACACATGCAAGTCGAGCNNNNNNNNNNNNNNNNNNNAGCGGCGGACGGGTGAGTAACGCGTGGGTAACCTGCCCTGTACACACGGATAACATACCGAAAGGTATGCTAATACGAGATGATATATNAAAGTTGCATGACTTTTATATCAAAGCTTTTGCGGTACAGGATGGACCCGCGTCTGATTAGCTAGTTGGTAAGGTAACGGCTTACCAAGGCGACGATCAGTAGCCGACCTGAGAGGGTGATCGGCCACACTGGAACTGAGACACGGTCCAGACTCCTACGGGAGGCAGCAGTGGGGAATATTGCACAATGGGCGAAAGCCTGATGCAGCAACGCCGCGTGAGCGATGAAGGCCTTCGGGTCGTAAAGCTCTGTCCTCAAGGAAGATAATGACGGTACTTGAGGAGGAAGCCCCGGCTAACTACGTGCCAGCAGCCGCGGTAATACGTAGGGGGNNAGCGTTATCCGGAATTACTGGGCGTAAAGGGTGCGTAGGCGGTCTTTCAAGCCAGAAGTGAAAGGCTACGGCTCAACCGTAGTAAGCTTTTGGAACTGTAAGACTTGAGTGCAGGAGAGGAGAGTGGAATTCCTAGTGTAGCGGTGAAATGCGTAGATATTAGGAGGAACACCAGTAGCGAAGGCGGCTCTCTGGACTGTAACTGACGCTGAGGCACGAAAGCGTGGGGAGCAAACAGGATTAGATACCCTGGTAGTCCACGCCGTAAACGATGAGTACTAGGTGTCGGGGGTTACCCCCCTCGGTGCCGCAGCTAACGCATTAAGTACTCCGCCTGGGAAGTACGCTCGCAAGAGTGAAACTCAAAGGAATTGACGGGGACCCGCACAAGTAGCGGAGCATGTGGTTTAATTCGAAGCAACGCGAAGAACCTTACCTAAGCTTGACATCCCATTGACCTCTCCCTAATCGGAGATTTCCCTTCGGGGACAGTGGTGACAGGTGGTGCATGGTTGTCGTCAGCTCGTGTCGTGAGATGTTGGGTTAAGTCCCGCAACGAGCGCAACCCTTGCCTTTAGTTGCCAGCATTAAGTTGGGCACTCTAGAGGGACTGCCGAGGATAACTCGGAGGAAGGTGGGGATGACGTCAAATCATCATGCCCCTTATGCTTAGGGCTACACACGTGCTACAATGGGTGGTACAGAGGGTTGCCAAACCGTGAGGTGGAGCTAATCCCTTAAAGCCATTCTCAGTTCGGATTGTAGGCTGAAACTCGCCTACATGAAGCTGGAGTTACTAGTAATCGCAGATCAGAATGCTGCGGTGAATGCGTTCCCGGGTCTTGTACACACCGCCCGTCACACCATGGGAGTTGGGGGCGCCCGAAGCCGGTTAGCTAACCTTTTGGAAGCGGCCGTCGAAGGTGAAACCAATGACNGGGGNNNNNNNGTAACAAGNNNNNNGTATCGGAAGNNNNNNNNGATCACCTCCTTTCT |
| Facklamia_hominis_ATCC_700628_NCBI_Y10772 | Facklamia_hominis | Y10772 | SEQ ID NO: 231 | CGAACGCTGGCGGCGTGCCTAATACATGCAAGTCGAACGAACGGAGCTAGGAACTGAACCCGGCAAAGTTAGTGGCGCACGGGTGAGTAACACGTGGAGAACCTACCCTTTTGCGGGGGATAACCATTGGAAACGATGACTAATACCGCATAGAATCGCAGATCGCATGATCAACGAAGGAAAGACGGCTTCGGCTGTCGCAAAAGGATGGCTCCGCGGTGCATTAGCTAGATGGTGGGGTAACGGCCTACCATGGCAATGATGCATAGCCGACCTGAGAGGGTGATCGGCCACATTGGGACTGAGACACGGCCCAAACTCCTACGGGAGGCAGCAGTAGGGANTCTTCCGCAATGGGCGCAANNCTGACGGAGCAACGCCGCGTGTGTGAAGAAGGTCTTCGGATCGTAAAGCACTGTTGTTAGAGAAGAACGACCGCTAGAGTAACTGTTAGCGGAGTGACGGTATC |

FIG. 16AAAO

| | | | |
|---|---|---|---|
| Flavonifractor_plautii_ATCC_29863_NCBI_AY724678 | Flavonifractor_plautii | AY724678 | SEQ ID NO: 232 | TAACCAGAAAGCCACGGCTAACTACGTGCCAGCAGCCGCGGTAATACGTAGGTGGCAAGCGTTGTCCGGATTTATTGG<br>GCGTAAAGGGAGCGCAGGCGGGATGTCAAGTCTGATGTGAAAGCCCACGGCTCAACCGGTGGAGGTCATTGGAAACTG<br>GGTCACTTGAGTNCAGAAGAGGAAAGNGGAATTCCATGTGTAGCGGTGAAATGCGTAGATATATGGAGGAACACCAGTG<br>GCGAAGGCGACTTTCTGGTCTGTAACTGACGCTGAAGCTCGAAAGCGTGGGGAGCAAACAGGATTAGATACCCTGGTA<br>GTCCACGCCGTAAACGATGAGTGCTAAGTGTTGGAGGGTTTCCACCCTCAGTGCTGAAGTTAACGCAATAAGCACTCC<br>GCCTGGGGAGTACGGCCGCAAGGCTGAAACTCAAAGGAATTGACGGGACCCGCACAAGCGGTGGAGCATGTGGTTT<br>AATTCGAAGCAACGCGAAGAACCTTACCAGGTCTTGACATCCTGCTAACGAAGCAGAGATGCACAGGTGCCCTTCGGGGAC<br>AAGAGAGACAGGTGGTGCATGGTTGTCGTCAGCTCGTGTCGTGAGATGTTGGGTTAAGTCCCGCAACGAGCGCAACCCTT<br>ATCACTAGTTGCCAGCATTCAGATGGGGACTCTAGTGAGACTGCCGCGTGACAAGCGGAGGAAGGTGGGGATGACGTC<br>AAATCATCAGGCCCTTATGACCTGGGCTACACACGTGTTCTCTGCAACTCGAGACGACACAATGAAGCGGAATCGCAGAT<br>AGCGAATCTCTTAAAGCCATTCTCAGTTCGGATTGTTCTCTGCAACTCGAGAGTACAAGCCGGAATCGCTAGTAATCGC<br>GGATCAATCATGCCGCGGTGAATACGTTCCCGGGTCTTGTACACACCGCCCGTCACACCATGGGAGTGAACCGGTAGTAACACCCG<br>AAGCCGGTGGCCTAACTTTATGAAGCGCGTGAAGGTGAAGTCGTAACAAGGTAGCCGTAT<br>CGGAAGGTGCGGCTGG |
| Flavonifractor_plautii_NML_070830_NCBI_EU874848 | Flavonifractor_plautii | EU874848 | SEQ ID NO: 233 | CGCTGGCGGCGTGCTTAACACATGCAAGTCGAACGGGTGCTCATGACGGAGGATTCGTCCAATGAGTTAGTTACCCTA<br>GTGAAAGACGGGCGTGAGTAACGCGTGAGGAACCTGCCTTGGAGAGGGGAATAACACTCCGAAAGGAGTGCTAATACCGC<br>ATGAAGCAGTTGGGTCGCATGGCTCGACTGCCAAAGATTTATCGCTCGAGATGGGCTCGCGTCTGATTAGCTAGTAG<br>GCGGGGTAACGGCCCACCTAGGCGACGATCAGTAGCCGGACTGAGAGGTTGACCGGCCACATTGGGACTGAGACACG<br>GCCCAGACTCCTACGGGAGGCAGCAGTGGGGAATATTGGGCAATGGGCGAAAGCCTGACCCAGCAACGCCGCGTGAA<br>GGAAGAAGGCTTTCGGGTTGTAAACTTCTTTTGTCGGGGACGAAAATGACGGTTACTGGGTAAGGCGCCTGTAGGCG<br>ACTACGTGCCAGCAGCCGCGGTAATACGGGGGTGCAAGCGTTACTCGGAATCACTGGGCGTAAAGGGCGTGTAGGCG<br>GCATTGCAAGTCAGATGTGAAATGTAGATATCGGCAAGCTCCAACTTGCTGGGCGATATCCATGATGCTGCAATAATGGAG<br>GCAATCGAATTCCGTGTGTAGCGGTGAAATGCGTAGATATCCAGGAGGAACACCAGTGGCGAAGGCGGATTCTGGAC<br>AGTAACTGACGCTGAGGCGCGAAAGCCAGGGGAGCAAACAGGATTAGATACCCTGGTAGTCCTGGCCGTAAACGATGAATG<br>CTAGGTGTGGGGGGGTCTGACCCCTCCCGTGCCGCAGTTAACACAATTAAGCATTCCACCTGGGGAGTACGACCGCAAG<br>GTTGAAACTCAAAGGAATTGACGGGGACCCGCACAAGCGGTGGAGTATGTGGTTTAATTCGAAGCAACGCGAAGAAC<br>CTTACCAGGGCTTGACATCGTCGGTCGTGTCCTAGAGATAGGAAGTTCCTTCGGGACACCGAGACAGGTGGTGCATG<br>ATGGTTGTCGTCAGCTCGTGTCGTGAGATGTTGGGTTAAGTCCCGCAACGAGCGCAACCCTTATTAGTTGCTACGC<br>AAGAGCACTCTAGCGAGACTGCCGTTGACAAACGGGAGGAAGGTGGGGATGACGTCAAATCATCATGCCCCTTATGTCC<br>TGGGCCACACACGTACTACAATGCGTTAACAACCGAGAAGCGGAAGCTAATCTGTTAAACCGGACCCCGAAGCATGCAAAGTCCTAGCTCCAGTTCGGATTGAAGTCTGCAACTCGACTTCATGAAGCTGGAATCGCTA<br>CCAGTTCCCGGGCCTTGTACACACCGCCCGTCACACCATGGGAGTTGGAATCGCGTAGTAATCGCGGATCAGCAATGCCGCGGTGAATACGT<br>GGAGGGCGGCGCCCTAACCGCAA<br>GCGCTTGCTTAACACATGCAAGTCGAACGGATTCGTCAACGATTGAGTGCTCAACGATTGAGTGCTAATACCGCATGATGC<br>ACGGGTGAGTAACGCGTGAGGAACCTGCCTTGGAGAGGGAATAACACTCCGAAAGGAGTGCTAATACCGCATGATGC<br>AGTTGGGTCGCATGGCTCGACTGCCAAAGATTTATCGCTCGAGATGGCCTCGCGTCTGATTAGCTAGTAGGTAGGT<br>AACGGCCTACCTAGGCGACGATCAGTAGCCGGACTGAGAGGTTGACCGGCCACATTGGGACTGAGACACGGCCCAGA<br>CTCCTACGGGAGGCAGCAGTGGGGAATATTGCACAATGGGCGAAAGCCTGATGCAGCAACGCCGCGTGAAGGAAGAA<br>GGCTTTCGGGTTGTAAACTTCTTTTGTCCGGGACGAAAATGACGGTACCGGACAAGAAGCACCCGGCTAACTACGT<br>GCCAGCAGCCGCGGTAATACGTAGGTGGCAAGCGTTGTCCGGATTTACTGGGCGTAAAGGGTGCGTAGGCGGGATGC<br>AAGTCCGATGTGAAAGGCAGTAGCCTGATATACGCGGAGCTCAACTCCGTAAAACCGATGGAGACTACTAG<br>GACGCTGAGGCGCGAAAGCGTGGGGAGCAAACAGGATTAGATACCCTGGTAGTCCACGCCGTAAACGATGATACT<br>GTGTGGGGGCTAAGGAGCGAAAGCGCGATTAGGTCCCGGCTAACTGAGTTAAGTACCGCGCCTGGGGAGTACGGCCG<br>CAAGGTTAAAACTCAAAGGAATTGACGGGGACCCGCACAAGCGGTGGAGCATGTGGTTTAATTCGACGCAAGCGCAA<br>GAACCTTACCAGGTCTTGACATCCCACTAACGAAGCAGAGATGCATTAGGTGCCCTTCGGGGAAAGTGAGACAGGTG<br>GTGCATGGTTGTCGTCAGCTCGTGTCGTGAGATGTTGGGTTAAGTCCCGCAACGAGCGCAACCCTTATTGTTAGTTA<br>CTCTAGCAGGACTGCCGTTGACAAATCATGCCCCTTATGTCCCTTATGTCCTTATGGCC |

FIG. 16AAAP

| | | | |
|---|---|---|---|
| Gardnerella_vaginalis_409_05_NCBI_CP001849 | Gardnerella_vaginalis | CP001849 | SEQ ID NO: 234 | ACACACGTACTACAAGTGGTGGTTAACAGAGAGGAGGCAATACCGCGAGGTGGAGCAAATCCCTAAAAGCCATCCAGTTC GGATTGCAGGCTGAAACCTGTACACACCGCCCGTCACACCATGGGAGTCAGCAGGTAATCGCAGGATCAGCGGTGAATACGTTC CGGGGCCCTTGTACAAACCGCCGTCAAGTCATGGAACAGGGTGAAGTCCGTAGCCTAACCGCAAGGAGGGG CGCGGCCGAAGGTGGGGTTCGATAATTGGGGTGAAGTCGTAACAAGGTAGCCG<br>TTTTCGTGGAGGGTTCGATTCGCTCAGGATGAACGCTGGCGGCGTGCTTAACACATGCAAGTCGAACGGGATCTGAC CAGCTTGCTGGTTGGTGAGAGTGGCGAACGGGTGAGTAATGCGTGACCAACCTGCCCATGCTCAGATAGCTCTTG GAAACAGGGTGGTAATGCTGGTAATGCGATGTCTTAGTGGGATGGGATGCGCAA CGTCCTATCAGCTTGTAGGCGGGGTAATGGCCCACCTAGGCGTCGATGTTAGTGGCAGTGGAATAATGCGCAATGTGCGACG CATTGGGACTGAGATACGGCCCAGACTCCTACGGGAGGCAGCAGTGGGGGAATATTGCGCAATGGGCGGAAGCCTGACGG CAGCGACGCCGCGTGCGGGATGAAGGCCTTCGGGTTGTAAACCGCTTTTCAGTTGGGGAAGAAGCTTCGGGGTGAGTGTA CCTTTGAATAAGAGCTTGTAGCCGCGGCTTAACTACGTGCCAGCAGCCGCGGTAATACGTAGGGGGCAAGCGTTATCCGGAATTATTG GGCGTAAAGAGCTCGTAGGCGGTTTGTCGCGTCGGTTGTGAAAGCCCATGGCTTAACCATGGGAATTGCGCGGATATCGGCA GGCGGGCTAGAGTGCAGTAGGGAGACTGGAATTCCTGGTGTAGCGGTGGAATGCGCAGATATATGGAAGAACACCAA TGGCGAAGGCAGGTCTCTGGGCTGTTACTGACGCTGAGGAGCGAAAGCGTGGGGAGCGAACAGGATTAGATACCCTGG TAGTCCACGCCGTAAACGGTGGGACTAGGTGTGGGGCCCATTCCACGGGGTCCCCGTGCCGCAGCTAACGCATTAAGTCC CCCGCCTGGGGAGTACGGCCGCAAGGCTAAAACTCAAAGGAATTGACGGGGGCCCGCACAAGCGGCGGAGCATGCGGATTAATTCG ATGCAACGCGAAGAACCTTACCAAGGCTTGACATGTCTGGACCGCCGTAGAGATACGGTTCCCCCTTCGGGGCAGCCAGA CACCAGGTGGTGCATGGTTGTCGTCAGCTCGTGTCGTGAGATGTTGGGTTAAGTCCCGCAACGAGCGCAA CCCTCGCCCTGTGTTGCCAGCATCATCAGCCGAATCAAGTACCTGGGATCCGGGGACTCCAGGGAGACTGCCAGGGTCAACTCCAAAAAGCCGGGAGGAAGGCGGGGATGACGTCAAGTCATCATGCCCCTTATGCCCCTGGGGCTACACACGTGCTACAATGGCGGACAAAGGGCAGCTCAGTGAGCGCGA ATGAAGCGCCGGCCGCGCAAGTTCGGTTAAAACCCAGAAATCGGGTCTCAGTTCGGATCGGGGACTGCAAGTCGAAGTGGG AGTAATCGCGGATCAGCATGCCGCGGTGAATACGTTCCCCGGGCCTGGCCACACCGCCCGTCAAGTCATGAAAGTCGGTAACACCCCGAAGCCGGTGGCCCAACCCCTTGGAGTCAGGGG |
| Gardnerella_vaginalis_AMD_NCBI_ADAM0100004 | Gardnerella_vaginalis | ADAM010000 4 | SEQ ID NO: 235 | CGTGGAGGGTTCGATTCGCTGGCTCAGGATGAACGCTGGCGGCGTGCTTAACACATGCAAGTCGAACGGGATCTAGTCAG CTTGCTGACTGGTGACGAGTGGCGAACGGGTGAGTAATGCGTGACCAACCTGCCCATGCTCAGATAGCTCTTGGAAA CGGGTGGTAATGCTGGATGCATGCCCAACTTGGTTAGAGGGATGGGATCGCGACGTC CTATCAGCTTGTAGGCGGGGTAATGGCCCACCAGGGCAGCTGATGTTAGTGGCAGTGGAATAATGCGCAATGTGCGACGCACATT GGGACTGAGATACGGCCCAGACTCCTACGGGAGGCAGCAGTGGGGAATATTGCGCAATGGCGGAAGCCTGACGCAG CGACGCCGCGTGCGGGATGAAGGCCTTCGGGTTGTAAACCGCTTGAGTGTACCT TGAATAAGAGCTTGTAGCCGGGGCTTAACTACGTGCCAGCAGCCGCGGTAATACGTAGGGGTGCAAGCGTTATCCGGAATTATTGGG CGTAAAGAGCTCGTAGGCGGTTTGTCGCGTCGGCTGTGAAAGCCCGTGGCTAACCATGTGATCGCTGGATGTCATGCAGACGGG CGGGCTAGAGTGCAGTAGGGAGACTGGAATTCCTGGTGTAGCGGTGGAATGCGCAGATATATGGAAGAACACCAATG GCGAAGGCAGGTCTCTGGGCTGTTACTGACGCTGAGGAGCGAAAGCGTGGGGAGCGAACAGGATTAGATACCCTGGTA GTCCACGCCGTAAACGGTGGGGACTAGGTGTGGGGCCCATTCCACGGGGTCCCCGTGCCGCAGCTAACGCATTAAGTCC CCCGCCTGGGGAGTACGGCCGCAAGGCTAAAACTCAAAGGAATTGACGGGGGCCCGCACAAGCGGCGGAGCATGCGGA TTAATTCGATGCAACGCGAAGAACCTTACCAAGGCTTGACATGTCTGGACCGCCGTAGAGATACGGTTCCCCCTTCGGGG CAGCCAGACACCAGGTGGTGCATGGTTGTCGTCAGCTCGTGTCGTGAGATGTTGGGTTAAGTCCCGCAACGAGCGCAACCC CTCGCCCTGTGTTGCCAGCATCATCAGCCCGGTGAATCAAGGGGGACTGCCAGGGAACTGCCAGGTCAACTCCAAAAACCGGGAGGAAGGCGGGGATGACGTCAAGTCATCATGCCCCTTATGTCCAAGGCTTCACACCCGTAAACGGTGATAGGCGGATCAAGTGCCAGCAGCCGCGGTAATACCGTAAGGAGCGTAGTCCCCTTAAAACCGGTCTTACCAAGCCTTAAGTGGGATGGAGTGCATGGCTGACATGG TGAATCGCAACGCGGTGGACTTCGAGGAGGATCAGGGTTGTAAGCTCTTAAGGTGGGATGAAGTCATGAGTGGA ACAAGGTAGCCGTACGGGAAGGTGCGGCTAACAAGGTA ACAAGGTAGCGTACCGGAAGGTGCGGCTAACAAGGTACGGTAAGCACTCCTTTCT |
| Gardnerella_vaginalis_ATCC_14019_NCBI_CP002104 | Gardnerella_vaginalis | CP002104 | SEQ ID NO: 236 | TTTTCGTGGAGGGTTCGATTCGCTGGCTCAGGATGAACGCTGGCGGCGTGCTTAACACATGCAAGTCGAACGGGATCTGAC CAGCTTGCTGGTTGGTGAGAGTGGCGAACGGGTGAGTAATGCGTGACCAACCTGCCCATGCTCAGATAGCTCTTG GAAACAGGGTGGTAATGCTGGATAATGCCGATGTCTTAGTGGGATGGGATCGCGA CGTCCTATCAGCTTGTAGGCGGGGTAATGGCCCACCCTAGGCGCTGACATGTTAGTGGCAGTGGAATAATGCGCAATGTGCGACGGCCA |

FIG. 16AAAQ

| | | | |
|---|---|---|---|
| Gardnerella_vaginalis_GV17_NCBI_HQ641662 | Gardnerella_vaginalis | HQ641662 | SEQ ID NO: 237 | CATTGGGACTGAGATACGGCCCAGACTCCTACGGGAGGCAGCAGTGGGGAATATTGCGCAATGGGCGGAAGCCTGACGCAGCGACGCCGCGTGAGGGATGAAGGCCTTCGGGTTGTAAACCTCTTTCAGCAGGGAAGAAGCGAAAGTGACGGTACCTGCAGAAGAAGCCCCGGCTAACTACGTGCCAGCAGCCGCGGTAATACGTAGGGTGCAAGCGTTGTCCGGAATTATTGGGCGTAAAGAGCTCGTAGGCGGTTTGTCGCGTCGTCTGTGAAATCCCGCAGCTCAACTGCGGGCTTGCAGTGGGTACGGGCAGACTTGAGTGCAGTAGGGGAGACTGGAATTCCTGGTGTAGCGGTGAAATGCGCAGATATCAGGAGGAACACCGATGGCGAAGGCAGGTCTCTGGGCTGTTACTGACGCTGAGGAGCGAAAGCATGGGGAGCGAACAGGATTAGATACCCTGGTAGTCCATGCCGTAAACGTTGGGCACTAGGTGTGGGGGGCCATTCCACGGTCTCCGTGCCGCAGCTAACGCATTAAGTGCCCCGCCTGGGGAGTACGGCCGCAAGGCTAAAACTCAAAGGAATTGACGGGGGCCCGCACAAGCGGCGGAGCATGCGGATTAATTCGATGCAACGCGAAGAACCTTACCAAGGCTTGACATGTGCCTGAGATGTGGGTTAAGTCCCGCAAGGGACGAAGGTGCTTCATGGTGACAGGTCGTCAATCATCATCGTCCCTAAAACGTCCCTTAAGGGGCACCTCACGAGACTGCCGGTGACAAACCGGAGGAAGGTGGGGATGACGTCAAGTCCGCATCATGCCCTTATGTCCTGGGCTACACACGTGCTACAATGGCCCGGTACAACGCGTAGCGAATCGTGAGACGGAGCTAATCGCCAAAATCGGGGTCCCAGTTCGGATTGAGGTCTGCAACTCGACCTCATGAAGTCGGAATCGCTAGTAATCGCAGGTCAGCAGCCGCGGTGAATACGTTCCCGGGCCTTGTACACACCGCCCGTCAAGTCATGAAAGTCGT |
| Granulicatella_sp_M658_99_3_NCBI_AJ271861 | Granulicatella_sp_M658_99_3 | AJ271861 | SEQ ID NO: 238 | ACGCTGGCGGCGTGCCTAATACATGCAAGTCGAACGAGTTCATTCACCGAGTGCTTGCACTCGAGTGGCGAACGGGTGAGTAACACGTGGGTAATCTGCCCATCAGAGGGGGATAACAGTTGGAAATGACTGCTAATACCGCATAACACCCGCATGGGCATCGGATGTGAGGAAAATGAAAGGCGCTTTGGCGTCACCACTTGGATGGACCTGCGTTGTATTAGCTAGTTGGTAAGGTAACGGCTTACCAAGGCAATGATGCATAGCCGAGTTGAGAGACTGATCGGCCACATTGGGACTGAGACACGGCCCAAACTCCTACGGGAGGCAGCAGTAGGGAATCTTCCGCAATGGACGAAAGTCTGACGGAGCAACGCCGCGTGAGTGAAGAAGGTTTTCGGATCGTAAAGCTCTGTTGTTAGAGAAGAACGTTGGTAGGAGTGGAAAATCTACCAAGTGACGGTAACTAACCAGAAAGGGACGGCTAACTACGTGCCAGCAGCCGCGGTAATACGTAGGTCCCAAGCGTTGTCCGGATTTATTGGGCGTAAAGCGAGCGCAGGCGGTTTCTTAAGTCTGATGTGAAAGCCCCCGGCTTAACCGGGGAGGGTCATTGGAAACTGGGGAACTTGAGTGCAGAAGGGAGAGTGGAATTCCATGTGTAGCGGTGAAATGCGTAGATATATGGAGGAACACCAGTGGCGAAGGCGGCTCTCTGGTCTGTAACTGACGCTGAGGCTCGAAAGCGTGGGGAGCAAACAGGATTAGATACCCTGGTAGTCCACGCCGTAAACGATGAGTGCTAGGTGTTGGGGGTTTCCGCCCCTCAGTGCCGCAGCTAACGCATTAAGCACTCCGCCTGGGGAGTACGACCGCAAGGTTGAAACTCAAAGGAATTGACGGGGGCCCGCACAAGCGGTGGAGCATGTGGTTTAATTCGAAGCAACGCGAAGAACCTTACCAGGTCTTGACATCCTTCTGACCGGTCTAGAGATAGACCTTTCCTTCGGGACAGAAGTGACAGGTGGTGCATGGTTGTCGTCAGCTCGTGTCGTGAGATGTTGGGTTAAGTCCCGCAACGAGCGCAACCCTTATCATTAGTTGCCAGCATTCAGTTGGGCACTCTAGTGATACTGCCGGTGACAAACCGGAGGAAGGTGGGGATGACGTCAAGTCATCATGCCCCTTATGACCAGGGCTACACACGTGCTACAATGGGTTGGTACAACGAGATGCCAACCTCGCGAGAGCGAGC |

FIG. 16AAAAR

| | | | |
|---|---|---|---|
| Lachnobacterium_bo vis_LRC_5362_NR_025127 | Lachnobacterium bovis | NR_025127 | SEQ ID NO: 239 | GTCAAATCAGGACATGCCCCTTATGACTTGGGCTACAACGTGTCTACAATGGATGGTACAAACGAGAAGCAAGACCGCGAGG GCAAGCGGAATCTCTTAAAGCCATTCTCAGTTCGGATTGTTCTCTGCAACTCGAGAGCATGAAGCTGGAATCGCTAGTAAT CGCGGATCAGCACGCCGCGGTGAATACGTTCCCGGGTCTTGTACACACCGCCCGTCACACCATGAGAGTTTGTAACAC CCAAAGTCGGTGAGGTAACCCTTCTGGGAG | GTTTGATCCTGGCTCAGGATGAACGCTGGCGGCGTGCTTAACACATGCAAGTCGAACGAAGCGCATTGTTTGAATTCT CGAAGGAATCAGTGACTGAGTGGCGGACGGGTGAGTAACGCGTGGGTAACCTGCCCATGTACAGGGGGACAACA GTTGGAAACGACTGCTAATACCGCATAAGCGCACGAGATTGCATGATCTAGTGTGAAAACTCCGGTGGTATATGATGG ACCCGCGTCTGATTAGCTAGTTGGTAACGGTAACGGCCTACCAAGGCGACGATCAGTAGCCGACCTGAGAGGGTGACCG GCCACATTGGGACTGAGACACGGCCCAGACTCCTACGGGAGGCAGCAGTGGGGAATATTGCACAATGGGCGAAAGCCT GATGCAGCGACGCCGCGTGAACGAAGAAGGTCTTCGGATTGTAAAGTTCTATCAGCAGGAAGAAGAAATGACGGGTACC TGACTAAGAAGCCCCGGCTAACTACGTGCCAGCAGCCGCGGTAATACGTAGGGGGCAAGCGTTATCCGGATTTACTGG GTAAAGGGCGCGCAGTAGGCGGCCGAAGCAAGCCTGAAGTGCGCGTAATACGCGGGTAATAGATATTAGGAGGCAACTG TCGAGCTAGAGTACGGTAGAGGGGGATATGGAATTCCTAGTGTAGCGGTGAAATGCGTAGATATTAGGAGGAACACCAGTG GCGAAGGCGGCCTTACTGGACCGATAACTGACGCTGAGGCTCGAAAGCGTGGGGAGCAAACAGGATTAGATACCCTG GTCCACGCCGTAAACGATGAATACTAGGTGTCGGGTGCGAAAGCGCAAACAGGATTAGATACCCTGGTA GGAGAGGTGTGCATGGTTGTCGTCAGCTCGTGTCGTGAGATGTTGGGTTAAGTCCCGCAACGAGCGCAACCCTTG TCCTTAGTAGCCAGCAGTAACCTGGGGCACTCTAGGGAGACTGCCAGGGATAACCTGGAGGAAGGTGGGGATGACGTCA AATCATCATGCCCCTTATGACCTGGGCTACACACGTGCTACAATGGCGAGTACAAAAGGAGCAATCAAGTGCGCAAAG ATCAGAATGCTGCGGTGAATCGCGGAATCGCGCGCTACAGTTCGGATTGTAGCCGCAACGCGAAGGTGAATGAATCGCG CGGTGACCTAACCGGTGAAGAAGAGGAAGGCGACCGGTCGAAGGCA |
| Lachnobacterium_bo vis_NK4B19_NCBI_GU324407 | Lachnobacterium bovis | GU324407 | SEQ ID NO: 240 | GAGTTTGATCATGGCTCAGGATGAACGCTGGCGGCGTGCTTAACACATGCAAGTCGAACGAAGCACATTTGAATTCT TCGGAACGAAGATAATGCGACTGAGTGGCGGACGGGTGAGTAACGCGTGGGTAACCTGCCATGTACAGGGGGACAAC AGTTGGAAACGACTGCTAATACCGCATAATCCGAGATTGCATGATCTAGTGTGAAAACTCCGGTGGTATATGATG ACCCCGCGTCTGATTAGCTAGTTGGTAAGGTAACGGCCTACCAAGGCGACGATCAGTAGCCGACCTGAGAGGGTGACC GGCCACATTGGGACTGAGACACGGCCCAGACTCCTACGGGAGGCAGCAGTGGGGAATATTGCACAATGGGCGAAAGC CTGATGCAGCAACGCCGCGTGAACGATGAAGGCCTTCGGGTCGTAAAGTTCTGTCATCGGGGACGAAGCAAGTGACGGT ACCGATGAAGAAAGCCCCGGCTAACTACGTGCCAGCAGCCGCGGTAATACGTAGGGGGCAAGCGTTATCCGGATTTACT GGGTGTAAAGGGAGCGTAGACGGGAAGGCAAGTGAAGTCTGATGTGAAAATGCGGGGCTCAACCATGGGGACATCAGG AAAACTGCTTTCCTTGAGTACCGGAGAGGGAAGCGGAATTCCTAGTGTAGCGGTGAAATGCGTAGATATTAGGAGGAACACCAG TGGCGAAGGCGGCTTACTGGACGGTAACTGACGCTGAGGCTCGAAAGCATGGGGAGCAAACAGGATTAGATACCCTGG TAGTCCACGCCGTAAACGATGATTACTAGGTGTCGGGTGGCAAAGCCATTCGGTGCCGCAGCTAACGCAATAAGTATTCC ACCTGGGGAGTACGTTCGCAAGAATGAAACTCAAAGGAATTGACGGGGACCCGCACAAGCGGTGGAGCATGTGGTTT AATTCGAAGCAACGCGAAGAACCTTACCAAGGCTTGACATCCCAATGACAAGCTATGTAAATGTCCGGAGCGCAACCCCTT GTCCTTAGTAGCCAGTGGTGTGGTGACAGTTGGTCGTGTCGTGAGATGTTGGGTTAAGTCCCGCAACGAGCGCAACCCCT GTCCTTAGTAGCCAGCACATTAAGTTGGGCACTCTAAGGAGACTGCCAGGGATAACCTGGAGGAAGGTGGGGATGACGTC AAATCATCATGCCCCTTATGACTTGGGCTACACACGTGCTACAATGGCCGGTACAACGAGGTTCCAAAGGGCGCGCTCGATAA GCAAATTGCAAAATAACGTCTCAGTTCGGATGCAGTCTGCAACTCGACTGCATGAAGTCGGAATCGCTAGTAATCGCA GATCAGCATGCCGCGGGTGAATACGTTCCCGGGTCTTGTACACACCGCCCGTCACACCATGGGAGTCAGTAACGCCCGAA GCCGGTGACCTAACCGGAAGGAGGAGGCGACCAAGGCA |
| Lachnospiraceae_ba cterium_1_1_57FAA_NCBI_ACTM01000 065 | Lachnospiraceae bacterium_1_1_57 FAA | ACTM01000006 5 | SEQ ID NO: 241 | AGAGTTTGATCCTGGCTCAGGATGAACGCTGGCGGCGTGCCTAACACATGCAAGTCGAACGAAGCACTTTGCTTGATT CTTCGGATGAAGAGGATTGTGACTGAGTGGCGGACGGGTGAGTAACGCGTGAGTAACCTGCCTCATACAGGGGATAA CAGTTAGAAATGACTGCTAATACCGCATAAGACCACACAGTCCGCATGGACACGTGTGGGGAAAACCTCCGGTGGTATGAGAT GGACCCGCGTCCATTAGCTAGTTGGTAGGTAACGGCCTACCAAGGCGACGATGGGTAGCCGGCCTGAGAGGGTGAAC GGCCACACATTGGGACTGAGACACGGCCCAAACTCCTACGGGAGGCAGCAGTGGGGAATATTGCACAATGGGCGAAAGCC CTGATGGCAGCGACGCCGCGTGAGCGATGAAGGTCTTCGGATCGTAAAGCTCTGTCTATAAAGCTATCAGCTAGATT ... |

FIG. 16AAAS

| | | | |
|---|---|---|---|
| Lachnospiraceae_ba cterium_1_4_56FAA _NCBI_ACTN01000 028 | Lachnospiraceae_ bacterium_1_4_56 FAA | ACTN01000002 8 | SEQ ID NO: 242 | TGACTAAGAAGCACCGGCTAAATACGTGCCAGCAGCCGCGGTAATACGTAGGTGGCAAGCGTTATCCGGATTTACTGGG TGTAAAGGGCGTAGAGCGATGGAGAGGTAAGCGGATTGATGTGAAATCCTAGTGCTTAACACTAGGAACACCAGTGG CGAAGGCGGCCGCCTGGACAGTACTGGACGAATAACTAGGTGTCGGGTGCGGTAGAGGGAGCTCGGAATTCCTGGTAG TCCACGCCGTAAACGATGACTACTAGGTGTCGGGTGGCAAGGATTCGGGTCCGTGCAGCAACGCAATAAGTAGTCCAC CTGGGGAGTACGTTCGCAAGAATGAAACTCAAAGGAATTGACGGGGACCCGCACAAGCGGTGGAGCATGTGGTTTAATT CGAAGCAACGCGAAGAACCTTACCTGTCTTGACATCCTGATGACAGCAGTGTAATGTGTCCCTTCGGGGACAGC GGAGACAGGTGGTGCATGGTTGTCGTCAGCTCGTGTCGTGAGATGTTGGGTTAAGTCCCGCAACGAGCGCAACCCTA TCTTTAGTAGCCAGCAGGTTAAGCTGGGCACTCTAGAGAGACTGCCGGGGACAAACCGGAGGAAGGTGGGGATGACGT CAAATCATCATGCCCCTTATGAGCAGGCAGGCTACACACCTGCAACTGCATGCATGTAAACAAAGGGAAGCGAGACCGCGAGGT GGAGCAAATCGCCAAAAATAACGTCTCAGTTCGGATTGTAGTCTGCAACTACACGAAGCTGGAATCCTGACTGGGTAAG CGGAATCAGAATGCGGTGACCAAGCCCGTTGATACATGTCTACAACAGCGGTGGCCCAGAAGCCGCCAGTAACGCG CGAAGTCAGTGAGCGAAACCCAAACCCTAAGGAGCCGGACCGAGTAACTGTTAAAGGGTAGTCGGTAAGGTCGTAACAAGGTA GCGTATCGGAAGGTGCGGCGGATCACCT |
| Lachnospiraceae_ba cterium_2_1_46FAA _NCBI_ADLB01000 035 | Lachnospiraceae_ bacterium_2_1_46 FAA | ADLB01000035 | SEQ ID NO: 243 | GAGAGTTTGATCCTGGCTCAGGATGAACGCTGGCGGCGTGCTTAACACATGCAAGTCGAACGAAGCACTTACCGGATT TCTTCGGGATGAAGTTTGTGACTGAGTGGCGGACGGGTGAGTAACGCGTGGGTAACCTGCCTCATACAGGGGGATA ACAGTTAGAAATGACTGCTAATACCGCATAAGACCACAGGTCCGCATGGACCTGGGGTGAAAACTCCGGTGGTATGAGAT GGACCCGCGTCTGATTAGCTAGTTGGTGAGGTAACGGCTTACCAAGGCGACGATCAGTAGCCGACCTGAGAGGGTGAC CGGCCACACATTGGGACTGAGACACGGCCCAAACTCCTACGGGAGGCAGCAGTGGGGAATATTGCACAATGGGCGAA AGCCTGATGCAGCGACGCCGCGTGAAGGATGACGGCCTTCGGGTTGTAAACTTCTTTTAGCAGGGAAGAAAATGACGGTACC TGACTAAGAAGCACCGGCTAAATACGTGCCAGCAGCCGCGGTAATACGTATGGTGCAACCCGGATTACTGGG TGTAAAGGGCGCGTAGGCGGATAGCAAGTCAGATGTGAAAATCCGGGGCTCAACCCCGGAATTGCATTTGATACTGCTA TTCTAGAGTGTGGAGAGGTAAGCGGAATTCCTAGTGTAGCGGTGAAATGCGTAGAGATTAGGAAGAACATCAGTGG CGAAGGCGGCTTACTGGACACGAACTGACGCTGAGGCGCGAAAGCGTGGGGAGCAAACAGGATTAGATACCCTGGTAG TCCACGCCGTAAACGATGGATACTAGGTGTAAGGGGGATCGACCCCTCCGTGCCGCAGTTAACACAATAAGTATCCCACCT GGGGAGTACGTTCGCAAGATTAAAACTCAAAGGAATTGACGGGGACCCGCACAAGCGGTGGAGCATGTGGTTTAATT CGAAGCAACGCGAAGAACCTTACCAAGTCTTGACATCCTCCTGACCGGTCTAGAGATAGGCCTTCTCCTTCGGGACAGG GGAGACAGGTGGTGCATGGTTGTCGTCAGCTCGTGTCGTGAGATGTTGGGTTAAGTCCCGCAACGAGCGCAACCCTT ATTGTCAGTTACTACGCAAGAGGACTCTGACGAGACTGCCAGTGATAAACTGGAGGAAGGTGGGGATGACGTCAAATCATCATGCC CCTTATGATCTGGGCTACACACGTGCTACAATGGCGTAAACAAAGGGAAGCGAAGCCGCGAGGTGGAGCCAATCCCA AAAAACGTATCTCAGTTCGGATTGTAGTCTGCAATCGACTACATGAAGCTGGAATCGCTAGTAATCGCGGATCAGAAT GCCGCGGTGAATACGTTCCCGGGCCTTGTACACACCGCCCGTCACACCATGGGAGTCAGTAATGCCCGAAGTCAGTGACCTA ACCGCAAGGGGGGGGGCGCCGAAGGTGAGGCTAGCGATTGGGGTGAAGTCGTAACAAGGTA GAAGACAGGGATGTGGCCGGTTAAGTCCCGACACGAGCGCAACCCT |

FIG. 16AAAT

| | | | |
|---|---|---|---|
| Lachnospiraceae_bacterium_2_1_58FAA_NCBI_ACTO01000052 | Lachnospiraceae bacterium_2_1_58 FAA | ACTO01000005 2 | SEQ ID NO: 244 | ATCTTCAGTAGCAGCAGCAAGTAAAGTTGGGCACTCTGGAAGAGACTGCCAGGATAACCTGGAGGAAGGTGGGACGACG TCAAATCATCATGCCCCTTATGACGGGAGGGCTACAAGTGGCGTAACGCGTAAACAAAGGGAAGCAAGCATGTGAGTG TGAGCAAATCTCAAAATAACGTCTCAATACGTTGAGTCTGCAACTGACAATCGACTGACAATCGAGCCAGGGTAATC GCGAATCAGAATGTCGCGGTAACCGGATTGCGCGGTCTTCCGGGATTACGTTCCGGGATTGCGCGGAGTCGTAACGCC CGAAGTCAGTGACCTAACCGACAAGGAAGGAGCTGCCGAAGGTGGGACTGATAACTGGGGTGAAGTCGTAACAAGGTAG CGGTATCGGAAGGTGCGGCTGGATCACCTTCT GAGAGTTTGATCCTGGCTCAGGATGAACGCTGGCGGCGTGCTTAACACATGCAAGTCGAGCGAAGCACCTTGACGGAT TCCTTCGGAATTGAAGCCTTGCTTGGTGACTGAGTGAGGCGGGGAGCGGTAACCTGGGGTAACCTGCCTCATACAGGGGGAT AACAGTTGGAAAACGGGTCTGATTAGGGTAGTTGGTGGGGTAACGGCCTACCAAGCCGACGATCAGTAGCCGACCTGAGGGAGGGTG ATGGACCCGGTCTGATTAGGGTAGTTGGTGGGGTAACGGCCTACCAAGCCGACGATCAGTAGCCGACCTGAGGAGGGTG CGGGCCACATTGGGACTGAGAACAGGGCCAGAATCCTAGGGGCTGATAGCGACGGGCCAAACTCCTACGGGAGGCAGCAGTGGGGGAATATTGCACAATGGGGAA CCCTGATGCAGCGACGCCGCGTGAGCGATGAAGGTCTTCGGATTGTAAAGCTCTATCAGCAGGGAAGAAAATGACGGTA CCTGACTAAGAAGCCCCGGCTAACTACGTGCCAGCAGCCGCGGTAATACGTAGGGGGCAAGCGTTATCCGGATTTACT GGGTGTAAAGGGAGCGTAGACGGCATGGAAAGCGCAGAATTCCTAGTGGTAGCGGTGAAATGCGTAGATATAGGAGGAACACCA CTGTCAGGCTAGTTCTGACCGTTCGGCTAGCGGTGAAATGCGTAGGGAAGCGTAGATATAGGAGAACACCAGTGGGCAACGC GTAGCTGGAAGGGCGCTTTCTGAAACTGCAATAGCGACCAATCATGACCGGGCATCGGGCATCGGGCGGCTAACCGGGCTACCCAATAAGATAT CCAACCCGGGGAGTACGTTCGCAAGAATGAAACTCAAAGGAATTGACGGGGACCCGCACAAGCGGTGGAGCATGTGGTT TAATTCGAAGCAACGCGAAGAACCTTACCTGGTCTTGACATCGTGTCAGAGACTGAGAGATTCCTTTCCCTTCGGGGACAC AGAGAAGACAGGTGGTGCATGGTTGTCGTCAGCTCGTGTCGTGAGATGTTGGGTTAAGTCCCGCAACGAGCGCAACCC CTATCTTTAGTAGCCAGCATTTTGAAGGGCACTCTAGAGAGACTGCCACACGGGGAACAGGATCGCTGGATGACCCGAG GTCAAATCATCATGCCCCTTATGACCTGGGCTACACAGGCGCTACACACGGTGGATGACATCAATCTAGACTG GGGAGCAAATCCCAAAATGCCAACTACTGCGGGATCAGGCAGATGCAATACAATCTTGAACAATACAATCGAGCGACTGCGGGAGGCGAAATCC TCGGAATCAGAATGTCGCGGTAACCCAAGGAGCTGCCGGGCGAGCTAGTGTGGCAACTCGACTACATGAAGGCGTGCTGCAATGCAATACGT AGCCGATATCGGAAGGTGCGGCTGGATCACCTTCT ACAAGAGAGTTTGATCCTGGCTCAGGATGAACGCTGGCGGCGTGCCTAACACATGCAAGTCGAACGAAGAGGTTAACGAGG AGTTTCGGATGGAATCGGTGCTAATACCGCATAAGTGGCGGACAGGGGTGAGGCGCTGGAATCGGAATCGAATCCAATCCGGTGTACAGG TAACACTTAGAATAGGTGCTAATACCGCATAAGACGAGCTGGTTCGGTTCGTGTGAAACCGGAAACTGTAAAACTCGGTGTACAGG CCCTGATGCAGCCGCGCGTGAGTGAAGAATATCCGCATATGTGCCGCAAGCAGGGCAGGGGCAGATCAGTAGCCGCACCAAGTCGA AACGGGCCACATTGGGACTGAGAACACACCCAGGCGCAACACCAAACTCCTACGGGAGGCAGCAGTATATCAATTCACAACGGGGAA CCCTGATGCAGCCACGCGTGAGGGGGAGCCGCGTGAACTCGACGCGGCGTCAACTCGACGGACAGCTAGACGAAAGCGTGAAAGCAA GGGTGTAAAGCTCTGTCAGCGGGATCATGGGTAGAAGAGCATGGGTAAGCCAGAAATGCGTGGTGTCTAGTGGTAGGCTAGGTATGGCATGGCTAAC TGCAGGGCTGGAGTGCAGGGCGCTTACGGATCGTATAACTGACGTTGAGGGCTGAAGCGTTAATCGGAATTGACTGGGGCATATAACCCCTG GTAGTCCACGCCGTAAACGATGATTACTAGTATGTAATATGCAACCAATCCAGCATAGGAAGCTGTCCGCGTAAGTAATACGGTAAGCA ATCCACCTGGGGAGTACGGCGCAAGGAATTGAAACTCAAAGGAATTGACGGGGCCGCACAAGCAGCGGAGCATGTGG TTTAATTCGAAGCAACGCGAAGAACCTTACCAAGTCTTGACATCTTCGGATCAGGCATCTGTGGCACACAGAGCCTATAACCGGAGATAACCTGA GCATTCTTAGTAGGCAAGAGGATTGATCACAGATCGCATGGTTGTCGTCAGCTCGTGTCGTGAGATGTTGGGTTAAGTCCCGCAACGAGCGCAAC GAGTCAAATCATCATGCCCCTTATGATTGGGCACTCTAAAGAGACTGCCGCCGTCAAGGCAGGAGGAAGGTGGGGATGACG TGCGGCTGGAGCCATGCATGTCAGCCCCTTATGGCGATAAACCCCTAAAGGACGACGACTACGGAGGATGGATCTGCAATCC AATCGGGAAATCAGCATGCTGCGGAGAGTTAAGAACAGCAGGGTGAAACCAAGGTACAAGCAGCTACGCAATAAG ATGTGGGAGCGAAATCAGCATGCTAAGCGAGAATACCGGCCGAATCGACTACTACAGAAAGCTGGAGTTGGAAATG AATCGCGGAATCGATGAACTTAACCGAGAATACGGCTAACCGAGCGCGGCCGGACCATGCGAGGTTGGAATGACCCCGCGCGCCGTCCACCATGTGCGGGTGAAGTCGTAACAAGG TAG |
| Lachnospiraceae_bacterium_3_1_57FAA_CT1_NCBI_ACTP01000124 | Lachnospiraceae bacterium_3_1_57 FAA | ACTP01000124 | SEQ ID NO: 245 | |

FIG. 16AAAAU

| | | SEQ ID NO: | |
|---|---|---|---|
| Lachnospiraceae_bacterium_4_1_37FAA_NCBI_ADCR01000030 | Lachnospiraceae bacterium 4_1_37 FAA | ADCR01000030 | SEQ ID NO: 246 | GAGAGTTTGATCCTGGCTCAGGATGAACGCTGGCGGCGTGCTTAACACATGCAAGTCGAACGAAGCACTTGAAT... (sequence) |
| Lachnospiraceae_bacterium_5_1_57FAA_NCBI_ACTR01000020 | Lachnospiraceae bacterium 5_1_57 FAA | ACTR01000020 | SEQ ID NO: 247 | GAGAGTTTGATCCTGGCTCAGGATGAACGCTGGCGGCGTGCCTAACACATGCAAGTCGAACGAAGCGCCTTGGCC... (sequence) |
| Lachnospiraceae_bacterium_6_1_63FAA_NCBI_ACTV01000014 | Lachnospiraceae bacterium 6_1_63 FAA | ACTV01000014 | SEQ ID NO: 248 | GATGAACGCTGGCGGCGTGCCTAACACATGCAAGTCGAGCGAAGCGAACTTATCATTGAC... (sequence) |

FIG. 16AAAV

| | | | |
|---|---|---|---|
| Lachnospiraceae_bacterium_8_1_57FAA_NCBI_ACWQ01000079 | Lachnospiraceae bacterium_8_1_57 FAA | ACWQ01000007 9 | SEQ ID NO: 249 | GTTTTTCTAGAGTGCGGAGAGGTAAGCGGAATTCCTAGTGTAGCGGTGAAATGCGTAGATATTAGGAGGAACACCAGT GGCGAAGGCGGCTTACTGGACGATAACTGACGGTGAGGCTCGAAAGCGTGGGGAGCAAACAGGATTAGATACCCTGGT AGTCCACGCCGTAAACGATGAATACTAGGTGTCGGGGGTTCGGCCCCTCGACCGCTGTCGTGCAGCTAACGCATTAAGT ACCTGGGAAGTACGGTCGCAAGACTGAAACTCAAAGGAATTGACGGGGGCCCGCACAAGCGGTGGAGCATGTGGTTTA ATTCGAAGCAACGCGAAGAACCTTACCAAGTCTTGACATCTGCCTGAGATGTTCCTTAACGGAACGGGGGGACAGAC AGGCAAGACAGGTGGTGCATGGCTGTCGTCAGCTCGTGTCGTGAGATGTTGGGTTAAGTCCCGCAACGAGCGCAACCCC TATCCTTAGTAGCCAGCAGGCACCCTTATGATTGATCGGGAGGAGCACTCTAGGAGACTGCCGGGGATAACCGGAGGAAG GTCAAATCATCATGCCCCTTATGACCTGGGCTACACACGTGCTACAATGGTATCCACAAAGGGAAGCGAAACTGCGAG GTTAGCAAATCTCAAAAATAACGTCCCAGTTCGGACTGTAGTCTGCAACTCGACCACATGAAGTCGGAATCGCTAGTAAT CGCGAATCAGAATGTCGCGGTGAATACGTTCCCGGGCCTTGTACACACCGCCCGTCACACCATGGGAGTCAGTAACGC CGAAGTCAGTGACCCAACCTTATGGAGGGAGCCGTCCGAAGGTGGGACTGGATGACTGGGGTG | 
| Lachnospiraceae_bacterium_9_1_43BFAA_NCBI_ACTX01000023 | Lachnospiraceae bacterium_9_1_43 BFAA | ACTX01000023 | SEQ ID NO: 250 | GAGAGTTTGATCCTGGCTCAGGATGAACGCTGGCGGCGTGCTTAACACATGCAAGTCGAACGAAGCACTTGATGAGAT TCTTCGGATGAAGAGGATTTGTGACTGAGTGGCGGACGGGTGAGTAACGCGTGGGTAACCTGCCTCATACAGGGGATA ACAGTTAGAAATGACTGCTAATACCCGCATAAGCACACAGGTGCGGGGCTGTAAAAACTCGGTGGTATGAGAGA TGGACCCGCGTCTGATTAGCTAGTAGGTGGGGTAACGGCCCACCTAGGCGACGATCAGTAGCCGACCTGAGAGGGTGA CCGGCCACATTGGGACTGAGACACGGCCCAAACTCCTACGGGAGGCAGCAGTGGGGAATATTGCACAATGGGGGAAAC CCTGATGCAGCGACGCCGCGTGAGCGAAGAAGTATTCGGTATGTAAAGCTCTATCAGCAGGGAAGATAACGACGGTAC CTGACTAAGAAGCACCGGCTAACTACGTGCCAGCAGCCGCGGTAATACGTAGGTGGCAAGCGTTATCCGGATTTACTGG GTGTAAAGGGAGCGTAGACGGTGAAGCAAGTCTGAAGTGAAAGCCCGGGGCTCAACCCCGGGACTGCTTTGGAAACTG CTTTTCTTGAGTGCCGGAGAGGTAAGCGGAATTCCTAGTGTAGCGGTGAAATGCGTAGATATTAGGAGGAACACCAGTG GCGAAGGCGGCTTACTGGACAGTAACTGACGTTGAGGCTCGAAAGCGTGGGAGCAAACAGGATTAGATACCCTGGTA GTCCACGCCGTAAACGATGATTACTAGGTGTTGGGGAGCAAAGCTCTTCGGTGCCGCAGCTAACGCAATAAGTAATCC ACCTGGGGAGTACGATCGCAAGATTAAAACTCAAAGGAATTGACGGGGACCCGCACAAGCGGTGGAGCATGTGGTTT AATTCGAAGCAACGCGAAGAACCTTACCAAGGCTTGACATCCCACTAACGAAGCAGAGATGCATAGGTGCCCTTCGGG GAAGTGGAGACAGGTGGTGCATGGCTGTCGTCAGCTCGTGTCGTGAGATGTTGGGTTAAGTCCCGCAACGAGCGCAAC CCCTATTCTTAGTAGCCAGCAGGTCAAGCTGGGCACTCTAGGGAGACTGCCAGGGATAACCTGGAGGAAGGTGGGGAT GACGTCAAATCATCATGCCCCTTATGACCTGGGCTACACACGTACCAATGGCGTAAACAAAGAGAAGCAAGACCGCGAGG |

FIG. 16AAAW

| | | | |
|---|---|---|---|
| Lachnospiraceae_bacterium_oral_taxon_F15_UY038_NCBI_HM099641 | Lachnospiraceae_bacterium_oral_taxon_F15 | HM099641 | SEQ ID NO: 251 | CCGAGCAAATCCCAAAATAACGTCTCAGTTCGGATTGTAGTCTGCAACTCGACTACACGAAGCTGGAATCGCTAGTAAT CGCGGAATCAGAATGTCGCGGTGAATACGTTCCCGGGTCTTGTACACACCGCCCGTCACACCATGGGAGTCAGTAACGC CCGAAGTCAGTGACCCAACCGCAAGGAGGGAGCTGCCGAAGGTGACCGATAACTGGGGTGAAGTCGTAACAAGGT AGCCGTATCGGAAGGTGCGGCTGGATCACCTTCT AGAGTTTGATCCTGGCTCAGGATGAACGCTGGCGGCGTGCCTAACACATGCAAGTCGAACGAAGCATTTAGAAGTTTTC GGACGGAAGAATGACTTAGTGACGGACGGGTGAGTAACGCGTGGGTAACCTGCCTTATACAGGGGATAACAGTTGGA AACGACTGCTAATACCGCATAAGCGCACAGTGACTTAGTCGGAAAAGATTTATCGGTATAAGATGAGCCCGC GTCTGATTAGCTAGTTGGTGAGGTAATGGCTCACCAAGGCGACGATCAGTAGCCGACCTGAGAGGGTGAACGGCCACA TTGGGACTGAGACACGGCCCAAACTCCTACGGGAGGCAGCAGTAGGGAATATTGCACAATGGGCGAAAGCCTGATGCA GCAACGCCGCGTGAAGGATGAAGTATTTCGGTATGTAAAGCTCTATCAGCAGGGAAGAAATTGACGGTACCTGACTAAG AAGCCCCGGCTAACTACGTGCCAGCAGCCGCGGTAATACGTAGGGGGCAAGCGTTATCCGGATTTACTGGGTGTAAAG GGTGCAGGAGGAGATAAGTGAATTTCCTGTGTGTCAGAGTGTTAAGTCCCGAGGCTCAACCTCGGAACTGGCGAAGG CGACTTACTGACTGAATACTAGAGGCTCGGAATCCCAATGAATTGACAGTGAAAGGAAAGGAAATGTGGTAATCCATGG CCTAAACGATGAATACTAGGTGTTGGCGGAATCTGACCTCGCAGTGCCGCAGCTAACGCACCAAGTATTCCACCTGG GCAACTCGAAAGCAAAAGCACCGGCAGGGAACTTCCGTGAGTCGAATCTCTGACAGGGTGTCGGGTGCTGTTCCCG CAGGTGCGATGCGTCATGTCGTGTCGTGGTTAAGTCCCGCAACGAGCGCAACCCCTATCTTTA GTAGCCAGCATTTAAGGTGGGCACTCTAGAGAGACTGCCGTCATGAATCCAAAGCAGCAAGCGGGATGACGTCAAATCA TCATGCCCCTTATGATTTGGGCTACACACGTGCTACAATGGTTCGGACAACAAAGGAGCAATCGCGATTGCGATCA TCCAAAAAATAACGTCCCAGTTCGGATTGTAGTCTGCAACTCGACTACATGAAGCTGGAATCGCTAGTAATCGCAAGTCA GATGCCCGCGTGAATACGTTCCCGGGCCTTGTACACACCGCCCGTCACACCATGGGAGTCGGTAACGCCCGAAGTCA GTGACCTAACCGAAGGAGGAGCTGCCGAAGGTAACTGGGGTGAAGTCGTAACAAGGTAGCCGT |
| Lactobacillus_acidophilus_ATCC_4796_NCBI_ACHN010000039 | Lactobacillus_acidophilus | ACHN010000039 | SEQ ID NO: 252 | GAGAGTTTGATCCTGGCTCAGGACGAACGCTGGCGGCGTGCCTAATACATGCAAGTCGAGCGAGCTGAACCAACAGAT TCACTTCGGTGATGACGTTGGGAACGCGAGCGGCGGATGGGTGAGTAACACGTGGGGAACCTGCCCCATAGTCTGGGA TACCACTTGGAAATAGGTGCTAATACCGGATAAGCGATCAGCTTCAAAGATCATGCGTC GCTATGGATGGCCCCGCGGTGCATTAGCTAGTTGGTAAGGTAACGGCTTACCAAGGCAATGATGCATAGCCGAGTTG AGAGACTGATCGGCCACATTGGGACTGAGACACGGCCCAAACTCCTACGGGAGGCAGCAGTAGGGAATCTTCCACAAT GGACGAAAGTCTGATGGAGCAATGCCGCGTGAGTGAAGAAGGTTTTCGGATCGTAAAGCTCTGTTGTTGGTGAAGAAG GATAGAGGTAGTAACTGGCCTTTATTTGACGGTAATCAACCAGAAAGTCACGGCTAACTACGTGCCAGCAGCCGCGGTA ATACGTAGGTGGCAAGCGTTGTCCGGATTTATTGGGCGTAAAGCGAGCGCAGGCGGAAGAATAAGTCTGATGTGAAAG CCCTCGGCTTAACCGAGGAACTGCATCGGAAACTGTTTTTCTTGAGTGCAGAAGAGGAGAGTGGAACTCCATGTGTAGC GGTGAAATGCGTAGATATATGGAAGAACACCAGTGGCGAAGGCGGCTCTCTGGTCTGCAACTGACGCTGAGGCTCGAA AGCATGGGTAGCGAACAGGATTAGATACCCTGGTAGTCCATGCCGTAAACGATGAGTGCTAAGTGTTGGAGGGTTTCCG CCCTTCAGTGCTGCAGCTAACGCATTAAGCACTCCGCCTGGGGAGTACGACCGCAAGGTTGAAACTCAAAGGAATTGAC GGGGGCCCGCACAAGCGGTGGAGCATGTGGTTTAATTCGAAGCAACGCGAAGAACCTTACCAGGTCTTGACATCTAGT GCAATGCTGAGAGATTCAGAGTTCCCTTCGGGGACAGAATGACAGGTGGTGCATGGTTGTCGTCAGCTCGTGTCGTGA GATGTTGGGTTAAGTCCCGCAACGAGCGCAACCCTTATTGTTAGTTGCCATCATTAAGTTGGGCACTCTAGCGAGACT GCCGGTGACAAACCGGAGGAAGGTGGGGATGACGTCAAGTCATCATGCCCCTTATGACCTGGGCTACACACGTGCTACA ATGGACAGTACAACGAGGAGCAAGCCTGCGAAGGCAAGCGAATCTCTTAAAGCTGTTCTCAGTTCGGACTGCAGTCTGC AACTCGACTGCACGAAGCTGGAATCGCTAGTAATCGCGGATCAGCACGCCGCGGTGAATACGTTCCCGGGCCTTGTAC ACACCGCCCGTCACACCATGGGAGTCTGCAATGCCCAAAGCCGGTGGCCTAACCTTTTGGAGGGAGCCGTCTAAGGCA GGGCAGATGACTGGGGTGAAGTCGTAACAAGGTAGCCGTACCGGAAGGTGCGGCTGGATCACCTCCTTCTA |
| Lactobacillus_acidophilus_NCFM_NCBI_CP000033 | Lactobacillus_acidophilus | CP000033 | SEQ ID NO: 253 | AAAACGAGAGTTTGATCCTGGCTCAGGACGAACGCTGGCGGCGTGCCTAATACATGCAAGTCGAGCGAGCTGAACCAA CAGATTCACTTCGGTGATGACGTTGGGAACGCGAGCGGCGGATGGGTGAGTAACACGTGGGTAACCTGCCCATAGTC TGGGATACCACTTGGAAACAGGTGCTAATACCGGATAAGAAAGCAGATCGCATGATCAGCTTATAAAAGGCGGCGTAAG CTGTCGCTATGGGATGGCCCCGCGGTGCATTAGCTAGTTGGTAAGGTAACGGCTTACCAAGGCAATGATGCATAGCCG AGTTGAGAGACTGATCGGCCACATTGGGACTGAGACACGGCCCAAACTCCTACGTACGGGAGGCAGCAGTAGGGAATCTTCC |

FIG. 16AAAX

| | | | |
|---|---|---|---|
| Lactobacillus_fermentum_28_3_CHN_NCBI_ACQG01000082 | Lactobacillus_fermentum | ACQG0100008 2 | SEQ ID NO: 254 | ACAATGGACGAAAGTCTGATGGAGCAGTGAGTGAAGAAGGTTTTCGGATCGTAAAGCTCTGTTGTTGGTGAA GAAGGATAGAGGTAGTAACGTGGCCTTATTTGACGGTAAGACGCCGAAAGTCAACTGGAGCAGCCGC GGTAATACGTAGGTGGCAAGCGTTGTCCGGATTTATTGGGCGTAAAGCGAGCGCAGGCGGAAGAATAAGTCTGATGTG AAAGCCCTCGGCTTAACCGAGGAACTGCATCGGAAACTGTTTTTCTTGAGTGCAGAAGAGGAGAGTGGAACTCCATGTG TAGCGGTGGAATGCGTAGATATATGGAAGAACACCAGTGGCGAAGGCGGCTCTCTGGACTGCAACTGACGCTGAGGCT AGAAAGCATGGGTAGCGAACAGGATTAGATACCCTGGTAGTCCATGCCGTAAACGATGAGTGCTAAGTGTTGGAGGGTT TCCGCCCTTCAGTGTCGCAGCTAACGCATTAAGCACTCCGCCTGGGGAGTACGACCGCAAGGTTGAAACTCAAAGGAAT TGACGGGGGCCCGCACAAGCGGTGGAGCATGTGGTTTAATTCGAAGCAACGCGAAGAACCTTACCAGGTCTTGACATC TAGTGCAATCCGTAGAGATACGGAGTTCCCTTCGGGGACACTAAGACAGAGGTGCATGGTTGTCGTCAGCTCGTGTC GTGAGATGTTGGGTTAAGTCCCGCAACGAGCGCAACCCCTATAGTTAGTTGCCAGCATTAAGTTGGGCACTCTAATGAGA CTGCCGGTGACAAACCGGAGGAAGGTGGGGATGACGTCAAGTCATCATGCCCCTTATGACCTGGGCTACACACGTGCT ACAATGGACGTACAACGAGTCGCAAGACCGCGAGGTGGAGCTAATCTCTTAAAGTCGTCCTCAGTTCGGACTGCAGTC TGCAACTCGACTGCACGAAGCTGGAATCGCTAGTAATCGCGGATCAGCACGCCGCGGTGAATACGTTCCCGGGCCTTG TACACACCGCCCGTCACACCATGGGAGTCTGCAATGCCCAAAGCCGGTGGCCTAACCTTCGGGATGGAGCCGTCTAAGG GCAGGGCAGATGACTGGGGTGAAGTCGTAACAAGGTAGCCGTAGGAGAACCTGCGGCTGGATCACCTCCTTTCTAAGG AAG |
| Lactobacillus_fermentum_ATCC_14931_NCBI_ACGI010000130 | Lactobacillus_fermentum | ACGI0100013 0 | SEQ ID NO: 255 | AACGAGTGGCGGACGGGTGAGTAACACGTAGGTAACCTGCCCAGAAGCGGGGGACAACATTTGGAAACAGATGCTAAT ACCGCATAACAACGTTGTTCGCATGAACAACGCTTGAAAGATGGCTTCTCGCTATCACTTCTGGATGGACCTGCGGTGCA TTAGCTTGTTGGTGGGGTAACGGCCTACCAAGGCGATGATGCATAGCCGAGTTGAGAGACTGATCGGCCACAATGGGA CTGAGACACGGCCCATACTCCTACGGGAGGCAGCAGTAGGGAATCTTCCACAAGGGCGCAAGCCTGATGGAGCAACA CCGCGTGAGTGAAGAAGGGTTTCGGCTCGTAAAGCTCTGTTGTTAAAGAAGAACACGTATGAGAGTAACTGTTCATACGT TGACGGTATTTAACCAGAAAGTCACGGCTAACTACGTGCCAGCAGCCGCGGTAATACGAGGTGGCAAGCGTTATCCGG ATTTATTGGGCGTAAAGAGAGTGCAGGCGGTTTTCTAAGTCTGATGTGAAAGCCTTCGGCTTAACCGAAGAAGTGCATC GGAAACTGGGAAACTTGAGTGCAGAAGAGGACAGTGGAACTCCATGTGTAGCGGTGAAATGCGTAGATATATGGAAGA ACACCAGTGGCGAAGGCGGCTGTCTGGTCTGCAACTGACGATTGAGGCTCGAAAGCATGGGTAGCGAACAGGATTAGATA GCCCTGGTAGTCCATGCCGTAAACGATGAGTGCTAGGTGTTGGAGGGTTTCCGCCCTTCAGTGCCGCAGCTAACGCATTA AGCACTCCGCCTGGGGAGTACGACCGCAAGGTTGAAACTCAAAGGAATTGACGGGGGCCCGCACAAGCGGTGGAGCA TGTGGTTTAATTCGAAGCTACGCGAAGAACCTTACCAGGTCTTGACATCTTGCGCTAACCCTAGAGATAGGGCGTTTCCT TCGGGAACGCAATGACAGGTGGTGCATGGTTGTCGTCAGCTCGTGTCGTGAGATGTTGGGTTAAGTCCCGCAACGAGC GCAACCCTTGTTACTAGTTGCCAGCATTCATGGTGGGCACTCTAGTGAGACTGCCGGTGACAAACCGGAGGAAGGTGGG GATGACGTCAAGTCATCATGCCCCTTATGACCTGGGCTACACACGTGCTACAATGGGCAGTACAACGAGTCGCAAACTC GTGAGAGTGAGCTAATCTCTTAAAGCTGTCTCAGTTCGGACTGTAGTCTGCAACTCGACTACACGAAGTCGGAATCGCT AGTAATCGCGGATCAG |
| | | | | TTTTATATGAGAGTTTGATCCTGGCTCAGGATGAACGCTGGCGGTGTGCCTAATACATGCAAGTCGAACGCGTTGGCCC AATTGATTGATGGTGCTTGCACCTGATTCAATTTTGGATTGTGCGGAATAAGAGTGAGTAACGCGTAGGTAACCT GCCCAGAAGCGGGGGACAACATTTGGAAACAGATGCTAATACCGCATAACAACGTTGTTCGCATGAACAACGCTTAAAA GATGGCTTCTCGCTATCACTTCTGGATGGACCTGCGGTGCATTAGCTTGTTGGTGGGGTAACGGCCTACCAAGGCGATG ATGCATAGCCGAGTTGAGAGACTGATCGGCCACAATGGGACTGAGACACGGCCCATACTCCTACGGGAGGCAGCAGTA GGGAATCTTCCACAAGGGCGCAAGCCTGATGGAGCAACACCGCGTGAGTGAAGAAGGGTTTCGGCTCGTAAAGCTCT GTTGTTAAAGAAGAACACGTATGAGAGTAACTGTTCATACGTTGACGGTATTTAACCAGAAAGCCACGGCTAACTACGTG CCAGCAGCCGCGGTAATACGAGGTGGCAAGCGTTATCCGGATTTATTGGGCGTAAAGAGAGTGCAGGCGGTTTTCTAA GTCTGATGTGAAAGCCTTCGGCTTAACCGAAGTAAGTGCATCGGAAACTGGGAAACTTGAGTGCAGAAGAGGACAGTG GAACTCCATGTGTAGCGGTGAAATGCGTAGATATATGGAAGAACACCAGTGGCGAAGGCGGCTGTCTGGTCTGCAACTGA CGCTTGAGGCTCGAAAGCATGGGTAGCGAACAGGATTAGATACCCTGGTAGTCCATGCCGTAAACGATGAGTGCTAGGTG TTGGAGGGTTTCCGCCCTTCAGTGCCGGAGCTAACGCATTAAGCACTCCGCCTGGGGAGTACGACCGCAAGGTTGAAA CTCAAAGGAATTGACGGGGGCCCGCACAAGCGGTGGAGCATGTGGTTTAATTCGAAGCTACGCGAAGAACCTTACCAG GTCTTGACATCTTGCGCTAACCCTAGAGATAGGGCGTTTCCTTCGGGGAACGCAATGACAGGTGGTGCATGGTTGTCGTC AGCTCGTGTCGTGAGATGTTGGGTTACGTCCCGCAACGAGCGCAACCCTTGTTACTAGTTGCCAGCATTAAGTTGGGCA |

FIG. 16AAAY

| | | | |
|---|---|---|---|
| Lactobacillus_fermentum_CECT_5716_NCBI_CP002033 | Lactobacillus_fermentum | CP002033 | SEQ ID NO: 256 | CTCTAGTGAGACTGCCGGTGACAAACCGGAGGAAGGTGGGGACGACGTCAGATACATCATGCCCTTATGACCTGGGCT ACACGTGCTACAATGGACGGTACAACGAGTCGCGAACTCGCGAGGGCAAGCAAATCTCTTAAAACCGTTCTCAGTTC GGACTGCAGGCTGCAACTGCGCCTGCACGAAGTCGG TTTTATATGAGAGTTTGATCCTGGCTCAGGATGAACGCTGGCGGTGTGCCTAATACATGCAAGTCGAACGCGTTGGCCC AATTGATTGATGGTGCTTGCACCTGATTTGGAAACAGATGCTAATACCGCATAAGAACCTTAAAA GCCAGAAGCGGGGGACAACATTTGGAAACAATGTCTTCGCATGAACAACGCTTAAAA GATGGCTTCGCTGTCACTTCTGGATGGACCTGCGATTAGTTTGTGGGTGACCTAACGCGTTGGGCCTAAAA ATGCATAGCCGAGTTGAGAGACTGATCGGCCACAATGGACTGATGGGCCCATACTCCTACGGAGCAGTA GGGAATCTTCCACAATGGGCGCAAGCCTGATGGGAGCAACGCCGCGTGAGTGAAGAAGGTTTCGGCTCGTAAAGCTCT GTTGTTAAAGAAGAACACGTATGAGAGTAGTGTTCATACGTTGACGGTATTTAACCAGAAAGTCACGGCTAACTACGTG CCAGCAGCCGCGGTAATACGTAGGTGGCAAGCGTTATCCGGATTTATTGGGCGTAAAGAGAGTGCAGGCGGTTTCTAA GTCTGATGTGAAAGCCTTCGGCTTAACCGAAGAACTGCATCGGAAACTGGATGACTTGAGTGCAGAAGAGGGTAGTGGA ACTCCATGTGTAGCGGTGGAATGCGTAGATATATGGAAGAACACCAGTGGCGAAGGCGGCTACCTGGTCTGCAACTGA CGCTGAGACTCGAAAGCATGGGTAGCGAACAGGATTAGATACCCTGGTAGTCCATGCCGTAAACGATGAGTGCTAGGTG TTGGAGGGTTTCCGCCCTTCAGTGCCGCAGCTAACGCATTAAGCACTCCGCCTGGGGAGTACGACCGCAAGGTTGAAA GCTCGACATCTTTGCGCCAACCGTAGAGATATGGCGTTTCCTTCGGAACGAATGACAGGTGGTGCATGGTCGTCGTC AGCTCGTGTCGTGAGATGTTGGGTTAAGTCCCGCAACGAGCGCAACCCTTGTTACTAGTTGCCAGCATTAAGTTGGGCA CTCTAGTGAGACTGCCGGTGACAATCAAGGAAGGTCGGGATGACGTCAAATCATCATGCCCCTTATGACCTGGGCT ACACACGTGCTACAATGGACAGTACAACGAGGAGCAAGCGTAATGCGAAGTCGGAATCCAAAAGCAGGTCTCAGTTC CCGGGGCCTTGTACACACCGCCCGTCACACCATGAGAGTTTGTAACACCCAAAGCCGGTGGCGTAACCTTTTAGGAGCC AGCCGCCTAAGGTGGGACAGATGATTAGGGTGAAGTCGTAACAAGGTAGCCGTAAGGGAACCTGCGGCTGGATCACCT CCTTTCT |
| Lactobacillus_fermentum_IFO_3956_NC_010610 | Lactobacillus_fermentum | NC_010610 | SEQ ID NO: 257 | TTTTATATGAGAGTTTGATCCTGGCTCAGGATGAACGCTGGCGGTGTGCCTAATACATGCAAGTCGAACGCGTTGGCCC AATTGATTGATGGTGCTTGCACCTGATTTGATTTGGAAACAGATGCTAATACCGCATAAGAACGCTTAAAA GCCAGAAGCGGGGGACAACATTTGGAAACAATGTCTTCGCATGAAGAACGCTTAAAA GATGGCTTCTCGCTATCACTTCTGGATGACCTGCGGTGCATTAGTTTGTTGGTGGGGTAACGGCCTACCAAGGCGATG ATGCATAGCCGAGTTGAGAGACTGATCGGCCACAATGGGACTGAGACACGGCCCATACTCCTACGGGAGGCAGCAGTA GGGAATCTTCCACAATGGGCGCAAGCCTGATGGAGCAACACCGCGTGAGTGAAGAAGGGTTTCGGCTCGTAAAGCTCT GTTGTTAAAGAAGAACACGTATGAGAGTAACTGTTCATACGTTGACGGTATTTAACCAGAAAGTCACGGCTAACTACGTG CCAGCAGCCGCGGTAATACGTAGGTGGCAAGCGTTATCCGGATTTATTGGGCGTAAAGAGAGTGCAGGCGGTTTTCTAA GTCTGATGTGAAAGCCTTCGGCTTAACCGAAGAACTGCATCGGAAACTGGATAACTTGAGTGCAGAAGAGGGTAGTGGA ACTCCATGTGTAGCGGTGGAATGCGTAGATATATGGAAGAACACCAGTGGCGAAGGCGGCTACCTGGTCTGCAACTGA CGCTGAGACTCGAAAGCATGGGTAGCGAACAGGATTAGATACCCTGGTAGTCCATGCCGTAAACGATGAGTGCTAAGTG TTGGAGGGTTTCCGCCCTTCAGTGCCGCAGCTAACGCATTAAGCATTCCGCCTGGGGAGTACGACCGCAAGGTTGAAA CTCAAAGGAATTGACGGGGGCCCGCACAAGCGGTGGAGCATGTGGTTTAATTCGAAGCTACGCGAAGAACCTTACCAG GCTTGACATCTTGCGCCAACCCTAGAGATAGGGCGTTTCCTTCGGGAACGCAATGACAGGTGGTGCATGGTCGTCGTC AGCTCGTGTCGTGAGATGTTGGGTTAAGTCCCGCAACGAGCGCAACCCTTGTTACTAGTTGCCAGCATTAAGTTGGGCA CTCTAGTGAGACTGCCGGTGACAAACCGGAGGAAGGTGGGGACGACGTCAGATCATCATGCCCCTTATGACCTGGGCT ACACACGTGCTACAATGGACGGTACAACGAGTCGCAATACCGCGAGGTGGAGCCAATCTCTTAAAACCGTTCTCAGTTC GGACTGTAGGCTGCAACTCGCCTACACGAAGTCGGAATCGCTAGTAATCGCGGATCAGCATGCCGCGGTGAATACGTT CCCGGGCCTTGTACACACCGCCCGTCACACCATGAGAGTTTGTAACACCCAAAGTCGGTGGGGTAACCTTTTAGGAGCC AGCCGCCTAAGGTGGGACAGATGATTAGGGTGAAGTCGTAACAAGGTAGCCGTAGGAGAACCTGCGGCTGGATCACCT CCTTTCT |
| Lactobacillus_fermentum_OMZ_1117_NCBI_FR667951 | Lactobacillus_fermentum | FR667951 | SEQ ID NO: 258 | TGAGTTTGATCNTGGCTCAGGATGAACGCTGGCGGTGTGCCTAATACATGCAAGTCGAACGCGTTGGCCCAATTGATTGAG TAACACGTAGGTAACCTGCCCAGAAGCGGGGGACAACATTTGGAAACAGATGCTAATACCGCATAACAAAGTCACTTCT GGATGGACCTGCGGGTGCATTAGCTTGTTGGTGGGGTAACGGCCTACCAAGGCGATGATGCATAGCCGAGTTGAGAGAC |

FIG. 16AAAZ

| | | | |
|---|---|---|---|
| Lactobacillus_fermen tum_SR2_NCBI_EF 460496 | Lactobacillus_ferm entum | EF460496 | SEQ ID NO: 259 | TGATCGGCCACACAATGGGACTGAGACACGGCCCAGACTCCTACGGGAGGCAGCAGTAGGGAATCTTCCACAATGGGCG AAGCCTGATGGAGCAACACCGCGTGAGTGAAGAAGGGTTTCGGCTCGTAAAGCTCTGTTGTTAAAGAAGAACGTGCGT TGAACCAGAGAAAGTCACGGCTAACTACGTGCCAGCAGCCGCGGTAATACGTAGGTGGCAAGCGTTATCCGGATTTATTGG GCGTAAAGAGAGTGCAGGCGGTTTTCTAAGTCTGATGTGAAAGCCTTCGGCTTAACCGAAGAAGTGCATCGGAAACTGG ATAACTTGAGTGCAGAAGAGGGTAGTGGAACTCCATGTGTAGCGGTGGAATGCGTAGATATATGGAAGAACACCAGTGG CGAAGGCGGCTACCTGGTCTGCAACTGACGCTGAGGCTCGAAAGCATGGGTAGCGAACAGGATTAGATACCCTGGTAGTC CATGCCGTAAACGATGAGTGCTAGGTGTTGGAGGGTTTCCGCCCTTCAGTGCCGCAGCTAACGCATTAAGCACTCCGCCTGGGGAGTA CGACCGCAAGGTTGAAACTCAAAGGAATTGACGGGGGCCCGCACAAGCGGTGGAGCATGTGGTTTAATTCGAAGCTAC GCGAAGAACCTTACCAGGTCTTGACATCTTGCGCCAACCCTAGAGATAGGGCGTTTCCTTCGGGAACGCAATGACAGGTGGT GTCCCGCAACGAGCGCAACCCTTGTTACTAGTTGCCAGCATTCAGTTGGGCACTCTAGTGAGACTGCCGGTGACAAACCGGAGG AAGGTGGGGATGACGTCAGATCATCATGCCCCTTATGACCTGGGCTACACACGTGCTACAATGGACAGAACAACGAGTCG CGAACTCGCGAGGGCAAGCAAATCTCTTCCGTTCTCAGTTCGGATCGCAGTCTGCAACTCGACTGCGTGAAGTCGGAATC GCTAGTAATCGCGGATCAGCATGC |
| Lactobacillus_gass eri_202_4_NCBI_ACO Z01000018 | Lactobacillus_gass eri | ACOZ01000001 8 | SEQ ID NO: 260 | AGTGGCGGACGGGTGAGTAACACGTGGGAACCTGCCTAATACATCGGAACAGATGCTAATACCGCATAATAACACCG CATAACAAAGTCACTTCTGGATGACCTTGCATTAGTGGTTGGGGGGTAACGGCCTACCAAGGCGATGATGCGTAGCCGA ATAGCCGAGTTGAGAGACTGATCGGCCACAATGGGACTGAGACACGGCCCATATACTCCTACGGGAGGCAGCAGTAGGGA ATCTTCCACAATGGACGCAAGTCTGATGGAGCAACGCCGCGTGAGTGAAGAAGGGTTTCGGCTCGTAAAGCTCTGTTGT TAAAGAAGATGACGTATCGGAGTTATTGGGCGTAAAGAGAGTGCAGGCGGTTCAATAAGTCTGATGTGAAAGCCTTCGGC TTAACCGGAGAAGTGCATCGGAAACTGTTGAACTTGAGTGCAGAAGAGGGTAGTGGAACTCCATGTGTAGCGGTGGAATG CGTAGATATATGGAAGAACACCAGTGGCGAAAGGCGGCTACCTGGTCTGCAACTGACGCTGAGGCTCGAAAGCATGGGTA GCGAACAGGATTAGATACCCTGGTAGTCCATGCCGTAAACGATGAGTGCTAAGTGTTGGAGGGTTTCCGCCCTTCAGTGCT GCAGCTAACGCATTAAGCACTCCGCCTGGGGAGTACGACCGCAAGGTTGAAACTCAAAGGAATTGACGGGGGCCCGCACAA GCGGTGGAGCATGTGGTTTAATTCGAAGCAACGCGAAGAACCTTACCAGGTCTTGACATCTTGCGCTAACCCTAGAGATAG GGCGTTTCCTTCGGGACGCAAAGACAGGTGGTGCATGGTTGTCGTCAGCTCGTGTCGTGAGATGTTGGGTTAAGTCCCGCA ACGAGCGCAACCCTTGTCATTAGTTGCCAGCATTAAGTTGGGCACTCTAATGAGACTGCCGGTGACAAACCGGAGGAAGGT GGGGATGACGTCAAGTCATCATGCCCCTTATGACCTGGGCTACACACGTGCTACAATGGACGGTACAACGAGTCGCAAGC CCGCGAGGGTAAGCCAATCTCTTAAAGCCGTTCTCAGTTCGGACTGTAGGCTGCAACTCGCCTACACGAAGCTGGAATCGCT AGTAATCGCGGATCAGCATGCCGCGGTGAATACGTTCCCGGGCCTT |

FIG. 16AAAAA

| | | | |
|---|---|---|---|
| Lactobacillus_gasser i_217_NCBI_AB517 146 | Lactobacillus_gass eri | AB517146 | SEQ ID NO: 261 | GTACACACCGCCCGTCACACCATGAGAGTCTGTAACACCCAAAGCCGGTGGGAATAACCTTTATAGGAGTCAGCCGTCTA AGGTAGGACAGATGATTAGGGTGAAGTCGTAACAAGGTAGCCGTAGGAGAACGTCGGGGATCACCTCCTTCTA GAGTTTGATTCCTGGCTCAGGACGAACGCTGGCGGCGTGCCTAATACATGCAAGTCGAGCGAGCGGAACTAACACTTT GGTGCTTGCACCAAATGAAACTAGATACAGCGCATGCCTAGGCGTGGCGAGCGAGCGAGCGGAGAGCTGGCCGTAGGA TGGGATAACACCTGGAAACAGGTGCTAATACCGCATAACAACGTTGTAGCGCATGTCTACACAAGTTTAAAAGCTCCGG ATCACTCTTGGATGGACCTGCGGTGCATTGGAACTGGGTAAGGTAACGGCTCACCAAGGCAATGATGCATAGCCGAGT TGAGAGACTGATCGGCCACATTGGAACTGAAGACAACGGCCTGCCGTGTAGCAAGCTGAGAAGCTTTGCTGTAAGCTTC ATGACCAAGCTGATGGAGCAAGCGCGGTGAGTGAAGAAGTTTCGGCTCGTAAGCTCTGTTGTTGGAAGA AAGATAGGGTAGTAACTGGCCTTTATTTGACGTGTAATTACTTAGAAAGATCACGGCTAACTACGTGCCAGCAGCCGCGGT AATACGTAGGTGGCAAGCGTTGTCCGGAATTTATTGGGCGTAAAGGGAAGCGCAGGCGGTTCAATAAGTCTGATGTG AAAGCCCTCGGCTCAACCGGAGAATTGCCATCAGAAACTGTTGAACTTGAGTGCAGAAGAGGAGAGTGGAACTCCATGTG TAGCGGTGGAATGCGTAGATATATGGAAGAACACCAGTGGCGAAGGCGGCTCTCTGGTCTGCAACTGACGCTGAGGCT CGAAAGCATGGGTAGCGAACAGGATTAGATACCCTGGTAGTCCATGCCGTAAGCTGTGTTGGGAGT CCGCCCTCAGTGCTGCAGCTAACGCATTAATTCGAAGCAACGCGAAGAACCTTACCAGGTCTTGACATC GAGTGCAAACGTTAGAGATAACGCGTCCCTTCGGGGACACTGAGACAGGGGTGCATGGCTGTCGTCAGCTCGTGTC GTGAGATGTTGGGTTAAGTCCCGCAACGAGCGCAACCCTTATCACTATGTTGCCATCATTAAGTTGGGCACTCTAGTGAGA CTGCCGGTGACAAACCGGAGGAAGGTGGGGATGACGTCAAGTCATCATGCCCCTTATGACCCTGGGCTACACGTGCT ACAATGGACGGTACAACGAGTCGCAAGACCGCGAGGTCAAGCAAATCTCTTAAAAGCCGTTCTCAGTTCGGACTGTAGG CTGCAACTCGCCTACATGAAGTCGGAATCGCTAGTAATCGCGGATCAGCATGCCGCGGTGAATACGTTCCCGGGCCTT GTACACACCGCCCGTCACACCATGAGAGTTTGTAACACCCAAAGCCGGTGAGGTAACCTTCGGGAGCC AGGACAGATGATTAGGGTGAAGTCGTAACAAGGTAGCC |
| Lactobacillus_gasser i_224_1_NCBI_ADF T01000035 | Lactobacillus_gass eri | ADFT01000035 | SEQ ID NO: 262 | TGAGAGTTTGATCCTGGCTCAGGACGAACGCTGGCGGCGTGCCTAATACATGCAAGTCGAGCGAGCTTGCCTAGATGA ATTTGGTGCTTGCACCAAATGAAACTAGATACAGCGCATGCCTAGGTGAGTAACACGTGAGTAACCTGCCCAAG AGACTGGGATAACACCTGGAAACAGATGCTAATACCGCATAACAACGTTGTTCGCATGAACAACGCTTAAAAGATGGTTC TGCTATCACTCTTGGATGGACCTGCGGTGCATTAGCTAGTTGGTAAGGTAACGGCTTACCAAGGCAATGATGCATAGCC GAGTTGAGAGACTGATCGGCCACATTGGGACTGAGACACGGCCCAAATCCTACGGGAGGCAGCAGTAGGGAATCTTC CACAATGGACGAAAGTCTGATGGAGCAACGCCGCGTGAGTGAAGAAGGTTTTCGGATCGTAAAGCTCTGTTGTTGGTG AAGAAAGATAGAGGTAGTAACTGGCCTCTTATTTGACGTTAATCAACCAGAAAGTCACGGCTAACTACGTGCCAGCAGCCG CGGTAATACGGAGGTGGCAACGGTTATCCGGATTTATTGGGCGTAAAGCGAGCGCAGGCGGAAGAATAAGTCTGATGTG AAAGCCCTCGGCTTAACCGAGGAACTGCATCGGAAACTGTTTTTCTTGAGTGCAGAAGAGGAGAGTGGAACTCCATGTG TAGCGGTGGAATGCGTAGATATATGGAAGAACACCAGTGGCGAAGGCGGCTCTCTGGTCTGTAACTGACGCTGAGGCT CGAAAGCATGGGTAGCGAACAGGATTAGATACCCTGGTAGTCCATGCCGTAAGCTGTGTTGGAGGTT GGGTTCCGCCCCTCAGTGCTGCAGCTAACGCATTAAGCATTCCGCCTGGGGAGTACGGCCGCAAGGCTGAAACTCAAAGGAAT TGACGGGGGCCCGCACAAGCGGTGGAGCATGTGGTTTAATTCGAAGCAACGCGAAGAACCTTACCAGGTCTTGACATC TTGAGCGCAATGACTGATTTTCGCGCAGAATAATCAAGCAGTGGTGGATGACGTCAAGTCATCATGGCCCTTATGACCTG GGCTACACACGTGCTACAATGGGACAGTGATTAGGGTAACGTAAGCAAGACCCAAAGCTGAGAGCGACAAGCTCAAAAAGCTGT CTCAGTTCGGACTGCAGTCTGCAACTCGACTGCACGAAGTCGGAATCGCTAGTAATCGCGGATCAGCATGCCGCGGT GAATACGTTCCCGGGCCTTGTACACACCGCCCGTCACACCATGGGAGTCTGCAATACCCAAAGTCCGTGGGATAACCTTT ATAGGAGTCAGCCGTCTAAGGTAGGACAGATGATTAGGGTGAAGTCGTAACAAGGTAGCC |
| Lactobacillus_gasser i_ATCC_33323_NC BI_CP000413 | Lactobacillus_gass eri | CP000413 | SEQ ID NO: 263 | TGAGAGTTTGATCCTGGCTCAGGACGAACGCTGGCGGCGTGCCTAATACATGCAAGTCGAGCGAGCTTGCCTAGATGA ATTTGGTGCTTGCACCAAATGAAACTAGATACAGCGCATGCCTAGGTGAGTAACACGTGGGTAACCTGCCCAAG AGACTGGGATAACACCTGGAAACAGATGCTAATACCGGATAACAACACTAGACGCATGTCTAGAGTTTAAAAGATGGTTC TGCTATCACTCTTGGATGGACCTGCGGTGCATTAGCTAGTTGGTGAGGTAACGGCTCACCAAGGCAATGATGCATAGCC GACTTGAGAGACTGATCGGCCACATTGGGACTGAGACACGGCCCAAACTCCTACGGGAGGCAGCAGTAGGGAATCTTC CACAATGGACGCAAGTCTGATGGAGCAACGCCGCGTGAGTGATGAAGGTTTTCGGATCGTAAAGCTCTGTTGTAGTG |

FIG. 16AAAAB

| | | | |
|---|---|---|---|
| Lactobacillus_gasser i_JV_V03_NCBI_AC GC01000023 | Lactobacillus_gass eri | ACGO0100002 3 | SEQ ID NO: 264 | AAGAAGATAGAGAGGTAGTAACTGGCCTTTATTTGACGGTAATTACTTAGAAAGTCACGGCTAACTACGTGCCAGCAGCCG<br>CGGTAATACGTAGGTGGCAAGCGTTGTCCGGATTTATTGGGCGTAAAGCGAGCGCAGGCGGTTCAATAAGTCTGATGTG<br>AAAGCCTTCGGCTCAACCGGAGAATTGCATCAGAAACTGTTGAACTTGAGTGCAGAAGAGGAGAGTGGAACTCCATGTG<br>TAGCGGTGGAATGCGTAGCGATACATGGAAGAACACCAGTGGCGAAGGCGGCTCTCTGGTCTGCAACTGACGCTGAGGCT<br>CGAAAGCATGGGTAGCGAACAGGATTAGATAGGCCATTCCGCCTGGGAGTGTACGGCCGCAAGGTTGAAACTCAAAGGAAT<br>TGACGGGGGCCCGCACAAGCGGTGGAGCATGTGGTTTAATTCGAAGCAACGCGAAGAACCTTACCAGGTCTTGACATC<br>CAGTGCAAACCTAAGAGATTAGGTGTTCCCTTCGGGGACACAGGTGACAGGTGGTGCATGGTCGTCGTCAGCTCGTGTC<br>GTGAGATGTTGGGTTAAGTCCCGCAACGAGCGCAACCCTTGTCATTAGTTGCCATCATTAAGTTGGGCACTCTAATGAGA<br>CTGCCGGTGACAAACCGGAGGAAGGTGGGGATGACGTCAAGTCATCATGCCCCTTATGACCTGGGCTACACACGTGCT<br>ACAATGGACGGTACAACGAGAAGCGAACCTGCGAAGGCAAGCGGATCTCTGAAAGCCGTTCTCAGTTCGGACTGTAGG<br>CTGCAACTCGCCTACATGAAGCTGGAATCGCTAGTAATCGCGGATCAGCACGCCGCGGTGAATACGTTCCCGGGCCTT<br>GTACACACCGCCCGTCACACCATGAGAGTCTGTAACACCCAAAGCCGGTGGATACACTTTATAGGAGTCAGCGCGTCTA<br>AGGTAGGACAGATGATTAGGGTGAAGTCGTAACAAGGTAGCCGTAGGAGAACCTGCGGCTGGATCACCTCCTTTCT |
| Lactobacillus_gasser i_NT05_NCBI_JN81 3104 | Lactobacillus_gass eri | JN813104 | SEQ ID NO: 265 | TGAGAGTTTGATCCTGGCTCAGGACGAACGCTGGCGGCGTGCCTAATACATGCAAGTCGAGCGAGCGCGGGACGGGTGAG<br>ATTTGGTGCTTGCACCAAATGAAACTAGATACAAGCGAGCGGCGGCGGGTGAGTAACACGTGGGTAACCTGCCCAAG<br>AGACTGGGATAACACCTGGAAACACTGGCTAATACCGGATAAACAAGTTGTCGCATGACTGCATGTGTTGAAAGATGGTTC<br>TGCTATCACTCTTGGATGACTGCGCGGTCCATTAGCTAGTTGGTAGGGTAACGGCCTACCAAGGCAATGATGCATAGCC<br>GAGTTGAGAGACTGATCGGCCACATTGGGACTGAGACACGGCCCAAACTCCTACGGGAGGCAGCAGTAGGGAATCTTC<br>CACAATGGACGCAAGTCTGATGGAGCAACGCCGCGTGAGTGAAGAAGGTTTTCGGCTCGTAAAGCTCTGTTGTTGGTGAGTG<br>AAGAAGATAGAGAGGTAGTAACTGGCCTTTATTTGACGGTAACTCAACGAGAAGTCACGGCTAACTACGTGCCAGCAGCCG<br>CGGTAATACGTAGGTGGCAAGCGTTGTCCGGATTTATTGGGCGTAAAGCGAGTGCAGGCGGTTCAATAAGTCTGATGTG<br>AAAGCCTTCGGCTCAACCGGAGAATTGCATCAGAAACTGTTGAACTTGAGTGCAGAAGAGGAGAGTGGAACTCCATGTG<br>TAGCGGTGGAATGCGTAGATATATGGAAGAACACCAGTGGCGAAGGCGGCTCTCTGGTCTGCAACTGACGCTGAGGTT<br>CGAAAGCATGGGTAGCGAACAGGATTAGATACCCTGGTAGTCCATGCCGTAAACGATGAGTGCTAAGTGTTGGGAGGTT<br>TCCGCCCTTCAGTGTCGCAGCTAACGCATTAAGCACTCCGCCTGGGGAGTACGACCGCAAGGTTGAAACTCAAAGGAAT<br>TGACGGGGGCCCGCACAAGCGGTGGAGCATGTGGTTTAATTCGAAGCAACGCGAAGAACCTTACCAGGTCTTGACATC<br>CAGTGCAAACCTAAGAGATTAGGAGTTCCCCTTCGGGGACACTGGATACAGGTGGTGCATGGCTGTCGTCAGCTCGTGTC<br>GTGAGATGTTGGGTTAAGTCCCGCAACGAGCGCAACCCCTTGTGCCATCATTAAGTTGGGCACTCTAATGAGA<br>CTGCCGGTGACAAACCGGAGGAAGGTGGGGATGACGTCAAGTCATCATGCCCCTTATGACCTGGGCTACACACGTGCT<br>ACAATGGACAGTACAACGAGGAGCAAGCCTGCGAAGGCAAGCGGATCTCTGAAAGTCGTTCTCAGTTCGGACTGTAGTCTGC<br>AACTCGACTACATGAAGCTGGAATCGCTAGTAATCGCGGATCAGCACGCCGCGGTGAATACGTTCCCGGGCCTTG<br>TACACACCGCCCGTCACACCATGAGAGTTTGTAACACCCAAAGCCGGTGGGGTAACCTTTATGGAGCCAGCCGCCTAAG<br>GTGGGACAGATGATTAGGGTGAAGTCGTAACAAGGTAGCCGTATCGGAAGGTGCGGCTGGATCACCTCCTTTCTA |
| Lactobacillus_gasser i_NT05_NCBI_JN81 3104 | Lactobacillus_gass eri | JN813104 | SEQ ID NO: 265 | GAGTTTGATCCTGGCTCAGGACGAACGCTGGCGGCGTGCCTAATACATGCAAGTCGAGCGAGCGGGGACGGGTGAG<br>TAACACGTGGGTAACCTGCCCAAGAGACTGGGATAACACCTGGAAACAGATGCTAATACCGGATAACAAAGTTCACTCTT<br>GGATGACTGCATTAGCTAGTTGGTAGGGTAACGGCCTACCAAGGCAATGATAGCGCAGTTGAGACT<br>GATGGGCCACATTGGGACTGAGACACGGCCCAAACTCCTACGGGAGGCAGCAGTAGGGAATCTTCCACAATGGACGCA<br>AGTCTGATGGAGCAACGCCGCGTGAGTGAAGAAGGTTTTCGGATCGTAAAGCTCTGTTGTTGGTGAAGAAGATGGTAAT<br>TACTTAGAAAGTCACGGCTAACTACGTGCCAGCAGCCGGGCTAATACGTAGGTGGCAAGCGTTGTCCGGATTATTGGG<br>CGTAAAGCGAGTGCAGGCGGTGCATGCGAGAGTCGATAATATGGAAGAACACCAGTGG<br>GAACTTGAGTGCAGAAGAGGAGAGTGGAACTCCATGTGTAGCGGTGGAATGCGTAGATATATGGAAGAACACCAGTGG<br>CGAAGGCGGCTCTCTGGTCTGCAACTGACGCTGAGGCTCGAAAGCATGGGTAGCAACAGGATTAGATACCCTGGTAGTC<br>CATGCCGTAAACGATGAGTGCTAAGTGTTGGGAGGTTTCCGCCTCAGTGCTGCAGCTAACGCATTAAGCACTCCGCCTGG<br>GGAGTACGACCGCAAGGTTGAAACTCAAAGGAATTGACGGGGGCCCGCACAAGCGGTGGAGCATGTGGTTTAATTCG<br>AAGCAACGCGAAGAACCTTACCAGGTCTTGACATCTTGTGCTACACCTAGAGATAGGTGTTCCCTTCGGGGACACAAGT<br>GACAGGTGGTGCATGGCTGTCGTCAGCTCGTGTCGTGAGATGTTGGGTTAAGTCCCGCAACGAGCGCAACCCTTATCATT<br>AGTTGCCATCATTCAGTTGGGCACTCTAATGAGACTGCCGGTGACAAACCGGAGGAAGGTGGGGACGACGTCAAGTCAT<br>CATGCCCCTTATGACCTGGGCTACACACGTGCTACAATGGACGGTACAACGAGTCGCGAACTCGCGAGGGCAAGCAAC<br>TCTCATAAAACCGTTCTCAGTTCGGACTGCAGTCTGCAACTCGACTGCACGAAGCTGGAATCGCTAGTAATCGCGGATC<br>AGCACGCCGCGGTGAATACGTTCCCGGGCCTTGTACACACCGCCCGTCACACCATGAGAGTTTGTAACACCCAAAGTCG<br>GTGGGGTAACCTTTATGGAGCCAGCCGCCTAAGGTGGGACAGATGATTAGGGTGAAGTCGTAACAAGGTAGCCGTAGGAGAA<br>GGTGGGGATGACGTCAAGTCTCATGGCCCTTATGACCTGGGCTACACACGTGCTACAATGGACGAACGAAGAGCG |

FIG. 16AAAAC

| | | SEQ ID NO. | |
|---|---|---|---|
| Lactobacillus_gasseri_SR1_NCBI_EF460495 | Lactobacillus_gasseri EF460495 | SEQ ID NO. 266 | AACCTGCGAAGGCAAGCGGATCTCTGCCGATTCTCAGTTGGGATGTAGGCTGCAACTCGCCTACATGAAGTCGGAATCGCT AGTAATCGGGATCAGCACGCCGCGGTGAATACGTTCCCGGGCCTTGTACACACCGCCCGTCACACCATGAGAGTCTG TAACACCCAAAGCCGGTGAGATAGTCAGGACATGATTAGGGTGAAGTCGTAACAAG |
| Oscillibacter_sp_G2_NCBI_HM626173 | Oscillibacter_sp_G2 HM626173 | SEQ ID NO. 267 | AGCGGCGGACGGGTGAGTAACACGTGGGTAACCTGCCCAGTAAGGGGGGGATAACAGCTGGAAACGGCTGCTAATACCG CATAACGCCCTTCGGGGGAAAGATTTATCGCTGAAAGATGGCCTCGCGTCTGATTAGATAGTTGGTGGGGTAACGGCCTACC AAGGCGACGATCAGTAGCCGACCTGAGAGGGTGACCGGCCACATTGGAACTGAGACACGGTCCAAACTCCTACGGGAGG CAGCAGTGGGGAATATTGCGCAATGGGCGAAAGCCTGACGGAGCAAGCCGCGTGAGTGATGAAGGCCTTCGGGTTGTAA ACCTCTTTCAGCAGGGAAGAACAATGACGGTACCTGCAGAAGAAGCCCCGGCTAACTACGTGCCAGCAGCCGCGGTAATAC GTAGGGGGCAAGCGTTGTCCGGATTCATTGGGCGTAAAGGGTGCGTAGGCGGTCTTTCAAGTCAGAGGTGAAAGGCTACG GCTCAACCGTAGTAAGCCCTTGAAACTGGAGAGCTTGAGTGCAGGAGAGGAGAGTGGAATTCCTAGTGTAGCGGTGAAATG CGTAGATATTAGGAGGAACACCAGTGGCGAAGGCGACTCTCTGGCCTGTAACTGACACTGAGGCACGAAAGCGTGGGGAG CAAACAGGATTAGATACCCTGGTAGTCCACGCCGTAAACGATGAATACTAGGTGTCGGGGAGCATCGCTCTTCGGTGCCGT CGCTAACGCAATAAGTATTCCACCTGGGGAGTACGCACCGCAAGGTGAAACTCAAAGGAATTGACGGGGACCCGCACAAGC GGTGGAGCATGTGGTTTAATTCGAAGCAACGCGAAGAACCTTACCAAGGCTTGACATGCAGGGAATGCCCAGAGATGGGTC CGTGTCCCTTCGGGGCTCCTGTACACAGGTGGTGCATGGTTGTCGTCAGCTCGTGTCGTGAGATGTTGGGTTAAGTCCCGC AACGAGCGCAACCCTTGCCGCTAGTTGCCATCATTAAGTTGGGCACTCTAGCGGGACTGCCGGTGCAAGCCGCGAGGAAGG TGGGGATGACGTCAAATCATCATGCCCCTTATGACCAGGGCTACACACGTGCTACAATGGCCGGTACAGAGGGCCGCGATG CCGCGAGGTGGAGCTAATCCCAAAAAGCCGGTCCCAGTTCGGATCGGAGTCTGCAACTCGACTCCGTGAAGCTGGAATCGC TAGTAATCGCAGGCTCAGCACGGCTGCGGTGAATACGTTCCCGGGTCCTGTACACACCGCCCGTCACACCATGGGAGTCCA GGCTAACC |
| Oscillibacter_valericigenes_Sjm18_20_N_CBI_AB238598 | Oscillibacter_valericigenes AB238598 | SEQ ID NO. 268 | GACGAACGCTGGCGGCGTGCTTAACACATGCAAGTCGAACGGAGCACCCTTGATTGAGTTTCGGCGCAAATGAGAGGA ATGCTTAGTGGCGAACGGGTGAGTAACGCGTGAGGAACCTGCCTTTCAGAGGGGACAACAGTTGGAAACGACTGCTA ATACCGCATGATACATTTGGGCGCATCCCGGCTGATTATCGCTGAAAGATGGCCTCGCGTCTGATTAGAT AGTTGGTGGGTAACGGCTCACCAAGGCGACGATCCCTAGCTGGTCTGAGAGGATGATCAGCCACACTGGGACTGAGA CACGGCCCAGACTCCTACGGGAGGCAGCAGTGGGGAATATTGCGCAATGGGCGAAAGCCTGACGGAGCAACGCCGCG TGAAGGAAGAAGGCCTTTCGGGTTGTAAACTTCTTTTAAGTAGGGAAGAAGCGTTGTCGGAGTTACTGGACGTAG CTAACTACGTGCCAGCAGCCGCGGTAATACGTAGGGGCTCAACCTCCAAACTGCATTTTCTTGAACTGCATAT AGGTAAGCTGGAATTCCTTGTGTAGCGGTGAAATGCGTAGATATATGGAAGAACACCAGTAGATACCCTGGTAGTCCACGCC AGGTAATCGGAGTTCAGGGAGGCGCGAAAGCGTGGGGAGCAAACAGGATTAGATACCCTGGTAGTCCACGCCGTAAACGATG AGAACTTGACCAGTAGGCGGAAGCAAAATATACAGGCCCCAGGAGCCACCTTCCGAAGCTAACGCGTTAAGTTCTCCGCCTGGGGAGTACGCACGCAAGTGAAGACTCAAGGAATTGACGGGGGCCCGCACAGGCGGTGGAGCATGTGGTTTAATTCGACGCAACGCGAAGAACCTTACCTGGGTCTTGACATCCCACTGACCTTAGATAGATTAAGCGATC |

FIG. 16AAAAD

| | | | |
|---|---|---|---|
| Oscillibacter_valerici genes_Sjm18_20_N R_074793 | Oscillibacter_valeri cigenes | NR_074793 | SEQ ID NO: 269 | AATACTAGGTGTGCGGGGACTGACCCCTGCGTGCCGCACAGTTAACACAATAAGTATTGCACCTGGGGAGTACGATCGCA AGGTTGAAACTCAAAGGAATTGACGGGGGCCCGCACAAGCGGTGGAGTATGTGGTTTAATTCGAAGCAACAGGTGGTGCA CTTACCAGGACTTACTACTAACGACATCCTAGTAGAGGAAGATACGTCAGGTGCCCTTGGGACAAAGTAGAGACAGGTGGTGCA TGGTTGTCGTCAGCTCGTGTCGTGAGATGTTGGGTTAAGTCCCGCAACGAGCGCAACCCTTATTGTTAGTTGCTACGCA AGAGCACTCTACAACGAGAACTGCCGTTGACAAACGGAGGAAGGTGGGGATGCAAAGCGGTGCAAGCGGATCATGCCCCTTATGTCCT GGGCTACACACGTAATACAATGGCGGTCAACATGGGAAGCCCTAAAGCCGGTCT CAGTTCGGATTGGAGTCTGCAACTCGACTCCATGAAGTCGGAATCGCTAGTAATCGCAGATCAGAATGCCGCGGTGAA TACGTTCCCGGGCCTTGTACACACCGCCCGTCACACCATGAAGTCGGAATCGCTAGTAATCGCAGATCAGAATGCCGCGGTGAA TGAAGGCGCGGCGAAGGTGGGTTTGATAATTGGGGTGG | ATTTATAGAGAGTTTGATCCTGGCTCAGGACGAACGCTGGCGGCGTGCTTAACACATGCAAGTCGAACATGGAGCACCCTT GATTGAGGTTTCGGCCAATGAGAAGCTTAGTGCGGACTGCTGAGTAACGCGTGAGGAACCTGCCTTCAGAG GGGGACAACAGTTGGAGAAATGATCGGTAATACCGCATGATACATTTGGCGACATCGCTTGAATGTCAAAGATTTATCGCT GAAAGATGGCCTCGCGTCTGATTAGATAGTTGGTGGGGTAACGGCCCACCAAGCCGACGATCAGTAGCCGGACTGAGA GGTTGACCGGCCACATTGGGACTGAGAATACGGCCCAGACTCCTACGGGAGGCAGCAGTGGGGAATATTGGGACAATGGA CGCAAGTCTGACCCAGCAACGCCGCGTGAAGGAAGAAGGCTTTCGGGTTGTAAACTTCTTTTAAGGGGAAGCGTTGTCCGG ACGGGTACCCCTTGAATAAGCCACGCGTAGGTAGCCCAGCAGTCAGATATCGGGGCTCAACCTCCAAACTGCATT ATTTACTGGGTGTAGGCGGATATCGGAAGAGGTAATGGAATTCCTGTGAGCGGTGAAATGCGTAGATATAAGGAGAAC TGAAACTACTTTTCTTGAGTATCGGAACGGCGATTACTGGACGAACAACTACTAGGTGTGCGGAGCAAACAGGATTAGATA ACCAGTGGCGAAGGCGACGCTGTAAACGATGAGTGCTAGGTGTGCGGGGGACTGACGACCCGGTCCTGGAGGTACGCC CCTGGTAGTCAAGCCGTCTAAAGGATTACGGCCTGTAAACGATGATAAGCCAAGATAAGGCGGGACCGACAGCCACCTGGT GTATTGCACCTCGGGGAGTTGACCGCAAGAAACTCAAAGGAATTGACGGGGACCGGCACGCAAGCGGGCCAGCCACCGGGGAC TTCGGGAAAGTAGAGACAGGTGGTGCATGGCTGTCGTCAGCTCGTGTCGTGAGATGTTGGGTTAAGTCCGCAACGA GCGCAACCCCTATTGTTAGTTGCTACGCAAGAGCACTCTAGCGAGACTGCCCGTCAACGAGAGGAAGGTGGGGAC GACGTCAAATCATCATGCCCCTTATGTCCAGGGCTACACACGTAATACAATGGCCGGTCCAGGCCTGACGACCCGCGAGGGAATCGCTA GTAATCGCCGGATCAGCATGCCGCGGTGAATACGTTCCCGGGCCTTGTACACACCGCCCGTCACACCATGGGAGTTGGGAAC ACCCGAAGTCCGTAGCCTAACCGCAAGGAGGGCGCCGCCAAGGTGGGTTGATAATTGGGGTGAAGTCGTAACA AGGTAGCCGTATCGGAAGGTGCGGCTGGATCACCTCCTTCTA | DACGAACGCTGGCGGCGTGCTTAACACATGCAAGTCGAACAGGAGGCCCAAGGAGGCGCCCCTTGAGCTGCCGAGTCGGACAACGACAGATTGG CTGCTTAGTGCGGTGGGACTGGTGAGTAAGTAACGCGTGAGAAACCTGGCCCTTGGAGCAAGGGAATTGGAAACGACTGCTA ATACCGATGATGATTATTTGTCGGGACATCAACTGGCCAAAGATTTATCGCTCAAAGATGGCCTCGCGGTCTGATTAGAT AGTTGGTGAGGTAACGGCCCACCAAGCCGACGATCAGTAGCCGACCTGAGAGGGTGAGCGCCACACACTGGAACTGAGA TACGGGCCCAGACTCCTACGGGAGGCAGCAGTGGGGAATATTGGGCAAGTGGGCGGGAAGCCTGACCCAGCAACGCCG CGTGAAGGAAGAAGGCTCTCTAAGGGCATTGTCTGATTCCTTAAACGGTGGAAGGCGTTACTGGGTGTAAAGGGTCTTGAATCGGA CCGGGTGTGCAAGTCCAGGCAGGTGGGAAATCCCAGGTGTCTAGCAGCTTCGGCCCTCAAGGAATTCTGCGGTTGGAGGCTGGAGCTGACCA CGTAGATATCGGAAGGAACACCAGTGGCGAAGGCGGCCCACTGGACAACAACTGACGGTGAGGAACGAAAGCGTGGGGAGCAAACCAGGATTAGAT ACCCTGGTAGTCCACGCCGTAAAACGATGGGGACTCCTAGGTGTGGGGACTCAGGTGTGGGGAGCAAACCAGGATTAGAT CAATACTAGGTGTCGGAGGACTGGACCCGTAAACGATGAGGTGAAGGCAGTCAACAACAGGATTAGAT ACCTTACCAAGGCCGGGGGCACACACGCGATGGGGCACATTAATTGACGGGGACCCGCACAAGCGGTGGAGCATGTGGTTTAATTCGAAGCAACGCGAAGAAC CTTACCAAGGCCGGGGGCACACACGCAATGGGGCATCAAGCGGTGGGGACCATTAATTCACCAGGTGGTCT ATGTTGCGGGAGATGTTGCCGTCGACCTCCTTAGGTGGCCGTGCGGATCGCGAGGGCAACGGCGAGATCGGCCCCCCTAGTTACGGCCGATAAAGCACACAGGTCGGCCCGCCAAAGCGGCCCGAAGCGCTGTTTCCTGTACACACCGCCCGAGACACCACAAGCGTCACCGCAGGCATAAAGCCTAGAGGCGAAACAACCGCCCGAAGCCTGGATCGGATCCAGCGACCTAGACCGAGGAACGGACCAAATTGGGGGATCGCTAGTACGGAGTCGAAGCCAAACCGAAGGTGAGGCAGCCAAGCGGCGGCAAGGTTGGGCCCCAAAGTGGCAACCCCTTAAAGCCTAAAGCCCTAGAGGAAGCGAAATCGGCAGGCCCAAGAATTGGGGGCAAAGCCCAGCCCCGAAGCAATCGCCAAGGCCGCCAACCCAAGCCGTAAAAGGTTGACACAGGACCGAAGTTCCGAAGAAATAGCAACGCATCCCCTTGTCACTAAGGGCACCCTCGCCCAAGAGGGTCAAGCCGCCCCGCCAAGTGCCAAGAACCCCCAAGCCAAGCGACCACCCAAGACCCAAGGCTGCCGGCCAAGCCCCACATCCCAAGACCAGACCCAACCCGAAGCCGCAAGACCAAGCAAGGGAAACGCACCCAGCCACCACCTCCGCCGAAGCGCCGCAGCCGCAAGCCCCGAAGCCCTAAGGGCCACGAGCCACCCCCCAACCAAGAAGCCGAAGCGCGAACCCCAAGGTGCCCAAGGAGCCCCAAGCAGCCCCTGGGGGCCAACCCAAGCGAAACGGCGAATTGCCTCCGGCCCCAAGCCCAAGGCCAACCCCTTCACGCCCAAGCGGAGTTCCCCGCCCAAGCCCCCTAACCCAAGAGCCCAAGGCCAAGCCCCCAAGAAGCCCAAGCCCAAGGCCCACGAAGAACCCCCCGCCCAAGCCCCCAAGCCCCTACACGCGAAGCCGAAGCCTAATCCCGAAGCAAGAACCCTCCAAGCCCACCAAGCCAAGCCCCCAGCCCCAAGCCGCCAAGTCCAAGCCGCCAAGCCAAGGCCGCCCCCGGGGCACGACGTGGGGTTCCGATAATTGGGGTG |
| Oscillospira_guillierm ondii_NCBI_AB0404 95 | Oscillospira_guillie rmondii | AB040495 | SEQ ID NO: 270 | |

FIG. 16AAAAE

| | | SEQ ID NO: | |
|---|---|---|---|
| Papilibacter_cinnami vorans_CiN1_NR_0 25025 | Papilibacter_cinna mivorans | NR_025025 | SEQ ID NO: 271 | GATCCTGGCTCAGGACGAACGCTGGCGGCGTGCCTAACACATGCAAGTCGAACGAAAATACCCAAAGCAGCAATGCGGG GGTATTTAGTGGCGGACGGGTGAGTAACGCGTGAGGAACAATCTGCCTTTTGGAGGGGATAACCGACTGGAAACGGTCGT TAATACCGCATAAGCGTATATGACGACATCTCGTCATATCAACAAAGGAGCAATCCGGAAGAAGATGAGCTCCGCTGAT TAGCTAGTTGGCGGGGTAAAGCCTACGGAAGCGACAGCCAGACCGGGTAGCCGGACCTGAGAGGTTGAACGGCCACATTGGAAC TGAGATACGGCCCAGACTCCTACGGGAGGCAGCAGTGAGGAATCTTTCCAGGAAGCAAAGCGTNCGGTNCTGGAAACAAGCC ACGGCTATCTACGTGCCAGCAGCCGCGGTTAATACGGAGGGTGCCAAGCGTTGTCCGGATTTACTGGGTGTAAAGGGCGC GTAGGCGGGCATTGCAATGCAGATGTGAAATGCGTAGATATTGCAAAGGCAATGCATCGTGAAGCTTGAGTGA TGGAGAGGCAGGCGGAATTCCTAGTGTAGCGGTGAAATGCGTAGATATCTAGGAGGAACACCAGTGGCGAAGGCGGCCT GCTGGACATTAACTGACGCTGAGGCGCGAAAGCGTGGGGAGCAAACAGGATTAGATACCCTGGTAGTCCACGCTGTAA ACGATGGATACTAGGTGTGGAGGGGGTCGACCCCTTCCGTGCCGGAGCTAACGCAATAAGTATCCGCACCTGGGGAGTACG ATCGCAAGATTAAAACTCAAAGGAATTGACGGGGGACCCGCACAAGCGGTGGAGCATGTGGTTTAATTCGAAGCAACGCG AAGAACCTTACCAGGACATTCACATGGCCTCAGGCAGTCATCAGAGATGACCTTCTCGAGAAGATAGAGACAGGT GGTGCATGGTTGTCGTCAGCTCGTGTGTGAGATGTTGGGTTAAGTCCCGCAACGAGCGCAACCCTTATGCTAGTTGC TACCCAAGAGCACTCTAGCGAGACTGCCGTTGACAAATCGAGGAAGGAAGGGAAGACAGTGATGCAAATGCCTCAAAAA CCGTCTGGGCTACACACACGCTACACAATGGACAAATCAACGAGCAGCGAGACCGCAAGGTGGAGCCAATCCCTAAAAATGTTCTCAGTTCCGATTGTAGTCTGCAACTCGACTACGGTGAAGCTGGAATCGCTAGTAATCGCGGATCAGCATGCCGCG GTGAATACGTTCCCGGGCCTTGTACACACCGCCCGTCACACCATGGGAGTCGGCAATACCCGAAGCCAGTGAGCTAAC CGCAAGGGGACGCNGCCGAAGGTAGGGTTCGATAATTGGGGTTGAACAAGGTAACCGTATCGGAAGGTGCG GC |
| Parabacteroides_dist asonis_ATCC_8503 NC_009615_NCBI_ CP000140 | Parabacteroides_d istasonis | CP000140 | SEQ ID NO: 272 | CAATTTAAACAACGAAGAGTTTGATCCTGGCTCAGGATGAACGCTAGCGGCAGGATAGACATGCAAGTCGAGGGGCA GCGGGGTTTGATGACGACCGGCGCACGGGTGAGTAACGCGTATGCAACTTGCCATCACAGAGGGGATACGTGATAT TAACCCGGCGAAAGTCGGACTAATACGGTAATGAGCAGCCATCCGCTGGTGATATTTGCTAAAGATTCATCGCTGAT AGATAGGGCATGCGTTCCATTAGGTAGTTGGTTGAAACGCCACATAGCCGACATGAGAGCCAAAGCGGCCCGAGATCGGAGGAGCCAAAACTGGAAAACA AGTTCCCCACATTGGTACTGAGACACGGACCAAACTCCTACGGGAGGCAGCAGTCAAAACCCCTCTTTTATAAGGGCGT AAGCCTGATCCAGCAGCCAAGTGCGGTGAAGGAAGGTTCTATGGATCGTAAACCTCTTCAGTCAGGGACGATAAATCGGG GACGGTTATCGGGATTTATTGGGTTGAGCGGTTAAGGTCCAAGCAGGCGGAATGCGTGTGGTGAGAGCTACTGGCTCAAC CGAGAATTCACCGCAGAACCCCCATTGCGAAGGCAGCCTGCCAAGGCACGCATTATCACTACGGGAATAAGCGTGGGGATCA CATAGAATTCCGGTGTAGCGGTGAAATGCGTAGATATCGGAGGAACACCAGTGGCGAAGCGGCCTCAAAAGCGTGGGAAGCGTGGGTAGCGGTGAAATGCATA AACAGGATTAGATACCTGGTAGTCCACCGCTGTAAACGATGGCTACAAAACGATTAGGATACATCACTGATGCAGAGCT GAAAGCAAACTGCCTTCCCCGTGGGAGTAGGCAACGCGGTAAGTAGCCCGCCAACGAGAAACAGCACGCCAGCCAGC GGAGGCAAGGATCACGGTTAATTCGATGATACGCAGAGGAACATATTCGGAGGTGCATGGTGGTCGTCGTAAAACA CCTTTCTAGCAATAGCCGTTGCCACTAGTTACTCAAAATCAGCACGGACTGCCCGGGACGATCGTCAAGCTGAGGAAAACA TAACGAGCGCAACCCTTATCATCATCATCACGGTTACCCACTGAGCAAGCACTGCCGGTGCAACGAGCTGAAGGTGTGGGGACTCGCAA AAGCCTGATCCAGCAGCCAAGTGCGGTGAAGGAAGGTTACAATGGCCGGTACAAAAGGGAGCCAATCGCGGACTCCGTGAA GAGGCAACCACTACAGTTGCGTGAGCAAAACCGCTCAGTTCGAAATGCCGGTCTCAGTTGGAACCGTGGACACGTGCTACAATCCGGGACTGGAGTGGACGCACGCCAGCCAGCCCAGCTGGACGCACGCCAGC GCTGGATTCGCTAGTAATCGCGCATCAGCCATGGCGCGGTGAATATGTTCCCGGGCCTTGTACACACCGCCCGTCAAGCCATGGGAGTGGTTCGTACCAACCAAGGGTACCTGGATTACTGGGGGTGAAGTCGTAACAAGGTAGCCGTACCGGAAG GTGCGGCTGGAACACCTGGCTGG GTAACAAG |
| Parabacteroides_dist asonis_B5_NCBI_E U722736 | Parabacteroides_d istasonis | EU722736 | SEQ ID NO: 273 | GAGTTTGATCCTGGCTCAGGATGAACGCTAGCGGCAGGCTTAACACATGCAAGTCGAGGGGCACGGGGAGT AACGCGTATCCAACTTACCTATCAGAACGGGATAAGTCGGATAATACCGGAAAGTCGGACTAATACCATGAATGCTGAT AGATAGGGCATCGCGTTCCATTAGGTAGTTGGCGGGGTAAGGCCCACCAAGCCGACGATGGATAGGGGTTCTGAGAGGA AGGTCCCCCACATTGGAACTGAGACACGGTCCAAACTCCTACGGGAGGCAGCAGTGAGGAATATTGGTCAATGGGCGT AAGCCTGAACCAGCCAAGTCGCGTGCAAGTCGAGTGCCGACAGAGCCTAAAAGGCCGCCTATTTATAAGGGAATACCAAGGCCGGACCAAGTCGCCGACAGAATCGGGAATCGCGGGATCCAATGGCACGTACCGCCGGACGCCAGCC TTATGAATAAAGGGATCGCTAGGGTAATACGGAGGCCGCATCTAAGGGAATCGTGTGGCTAACCCAAACCCGGCAAGCTGAGGAATTGTGGGCGCTTTAAGGCTAATACCATTCCCAACCATAGAACTTCAGAATCGTTAGATATCACGCAGAACCCGATTGC AGGCTGAGTATGTGTTGAGGCAGGGGAATACGCGAATGCCAAATGCACAGAAACCCGATTGC |

FIG. 16AAAAF

| | | | |
|---|---|---|---|
| | | | GAAGGCAGCCTGCCAAGCCAACTGATCACTAGCTGTTGCCGTGATGACGCTGAATGCACGAAAGCGTGGGGATCAAACAGGATTAGATACCCTGGTAGTCC<br>ACGCCAGTAAACGATGAATCACTAGCTGTTTGCCGTGATGACGCTGAATGCACGAAAGCGTTAAGTGATCCACCTGGGGAGTACG<br>CGGCAACGGTGAAACTCAAAGAATTGACGGGGGTGCATGCACGGAAGAACATGTGGTTTAATTCGATGATACGC<br>GAGGAACCTTACCCGGGTTTGAACGCACGTAGTTACTAACGACTTGGTCATGCATGGAAGCCTGGAGG<br>TGCCATAACGAGCACAACCCTTGCCACTAGTTACTAACGACTTGCTGAGAGACTCGACACGTGACAAGCGTGAAG<br>AAGGCGGGGATGACGTCAAATCAGCATCGCCCACGTCGAGGAGGATCTCGGGACGACGGAGTCTGCTGACAAGCGTGAAGCTGGATTCG<br>CCACCTGCCGACAGGAGGCATAGCCATGCCTATCCGTGAATACGTTCCCGGGCCTTGTACACCGCCGTCAAGCCATGGAGC<br>CTAGTAATCCGCATCGGAGTCGCTATCGACCTCGAATATCGGGCTAAGTCGTAACAAGGTA | SEQ ID NO: 274 |
| Parabacteroides_dist asonis_JCM_13401_21_48_NCBI_AB238 924 | Parabacteroides_d istasonis | AB238924 | AGAGTTTGATCCTGGCTCAGGATGAACGCTAGCGACAGGCTTAACACATGCAAGTCGAGGGGGCAGCAGGTAGCAAT<br>ACCCGCGCACGGGACCGGCAACCGGCAACGGGGATCAACTTACCTATCAGGAGGATAACCGGCGAAAGTC<br>GGACTAATACCCGATGAAGCAGGAGCCCCGCATGGGGTGAGTGAACGCTATGATATTCATCGCTGATAGAATAGGCATGCGTTC<br>CATTAGGCAGTTGGCGGGTAACGGCCCACCAAACCGACGATGGATAGGGTTCTGAGAGGAAGGTCCCCACATTGG<br>TACTGAGACACGGACCAAACTCCTACGGAGGCAGCAGTGAGGAATATTGGTCAATGGGCGTAAGCCTGAACCAGCCA<br>AGTCGCGTGAGGGATGAAGGTTCTATGGATCGTAAACCTCTTTTATAAGGGAATAAGTCGGGACGTGTCCCGTTTTGT<br>ATGTACCTTATGAATAAGGATCGCTAACTCGTGCCAGCAGCCGCGGTAATAGGCTATCGGCAGCAATAGAATTCGGATT<br>TATTGGGTTTAAAGGGTGCGTAGATGTGTTGAGGCAGGCGTTGAAATGCTTGGGGCTCAACATAGATCACG<br>AACTGGGAGGCTTGAGTGATGTTGGAGCGAGCAGTTGGAGGAATAAGCGGTAGTATCAAACAGGATTAGATACC<br>CTGGTAGTCACGCAGTACTACTGACATGTCTGATGCCAGAGCATGATCAGCTGTAAGCGACAGTGTAAGCGTTAAGTGAT<br>CCACCTGGGGAGTACGATCGCAAGATTAAAACTCAAAGGAATTGACGGGGGCCCGCACAAGCGGAGGAACATGTGGT<br>TTAATTCGATGATACGCGAGGAACCTTACCCGGTCTTGACATCGTGCCGTGAGCCGTGAGAGACTCGTGACACTAAGGCAACGCCA<br>CTGCCGCAGTAGTTACTAACGATAACTAGCTGTTTGCGATACGTGTTACAATGGCCGTGACAGCGTGCACAGCGGGACGA<br>CGGCCGCAATCAGCAGTACGCGGGAGTACGGTCGCAAGGCTAAAACTCAAAGGAATTGACGGGGGCCCGCACAAGCGGAGGAACATGTGGT<br>CAGGAGCGAATCAGGATACCGCGGGAGTACGGTCGCAAGGCTAAAACTCAAAGGAATTGACGGGGGCCCGCACAAGCGGAGGAACATGTGGT<br>AATCGCGCATCGAAGTCGGCCATGCCGACCCGTGAATACGTTCCCGGGCCTTGTACACACCGCCCGTCAAGCCATGGGAGCTGGGT<br>GGTACCTGAAGTCGGCCTAGTCTAACCGGGCTAAGTCGTAACAAGGTAAC | SEQ ID NO: 275 |
| Parabacteroides_dist asonis_JCM_13402_231_NCBI_AB238925 | Parabacteroides_d istasonis | AB238925 | AGAGTTTGATCCTGGCTCAGGATGAACGCTAGCGACAGGCTTAACACATGCAAGTCGAGGGGGCAGCAGGTAGCAAT<br>ACCCGGGCTAGCGCCGGCGACCGGCAACGGGGATCAACTTACCTATCAGGAGGATAACCGGCGAAAGTC<br>GGACTAATACCCGATGAAGCAGGAGCCCGCACATGTGGTGAGTGAACGCTATGATATTCATCGCTGATAGATAGGGCATGCGTTC<br>CATTAGGCAGTTGGCGGGTAACGGCCCACCAAACCGACGATGGATAGGGTTCTGAGAGGAAGGTCCCCACATTGG<br>TACTGAGACACGGACCAAACTCCTACGGAGGCAGCAGTGAGGAATATTGGTCAATGGGCGTAAGCCTGAACCAGCCA<br>ATGCGCGTGAAGGATGAAGGTTCTATGGATCGTAAACCTCTTTTATAAGGGAATAAGTCGGGACGTGTCCCGTTTTGT<br>ATGTACCTTATGAATAAGGATCGCTAACTCGTGCCAGCAGCCGCGGTAATAGGCTATCGGCAGCAATAGAATTCGGATT<br>TATTGGGTTTAAAGGGTGCGTAGATGTGTTGAGGCAGGCGTTGAAATGCTTGGGGCTCAACATAGATCACG<br>AACTGGGAGGCTTGAGTGATGTTGAGCGAGCAGTTGGAGGAATAAGCGGTAGTATCAAACAGGATTAGATACC<br>CTGGTAGTCACGCAGTACTACTGACATGTCTGATGCCAGAGCATGATCAGCTGTAAGCGACAGTGTAAGCGTTAAGTGAT<br>CCACCTGGGGAGTACGATCGCAAGATTAAAACTCAAAGGAATTGACGGGGGCCCGCACAAGCGGAGGAACATGTGGT<br>TTAATTCGATGATACGCGAGGAACCTTACCCGGTCTTGACATCGTGCCATGCCGGAGCCGTGAGAGACTCGTAGCAATAG<br>CGTCAAATCAGGAATGATCAAGCTAGCATCCGGGGACGATGGTTACAATGGCCGTGACAGCGTGCACAGCGGGACGA<br>CAGGAGCGAATCCGCGTAACGGTGAACCTTGTACACACCGGGAGCCGTGAGCGAGCCGTGAGCGGGACGA<br>AATCGCGCATCGAAGTCGGCCATGCCGACCCGTGAATACGTTCCCGGGCCTTGTACACACCGCCCGTCAAGCCATGGGAGCTGGGT<br>GGTACCTGAAGTCGGCCGAAAAGATCCGGCTAAGTCGTAACAAGGTAAC | SEQ ID NO: 275 |

FIG. 16AAAAG

| | | | |
|---|---|---|---|
| Parabacteroides_dist asonis_JCM_13404_297_NCBI_AB238927 | Parabacteroides_d istasonis | AB238927 | SEQ ID NO: 276 | AGAGTTTGATCCTGGCTCAGGATGAACGCTAGCGACACAGGCTTAACACATGCAAGTCGAGGGGCAGCACAAGGTAGCAAT ACCGGGTGGCGACCGGCGCACGGGTGAGTAACGCGTATGCAACTTACCTATCAGAGGGGGATAATCCGGAGAAAGTC GGACTAATACCGCGATGAAGCAGGGGTCCCGCATGGGAATATTTGCTAAAGATTCATCGCTGATAGGTAGGTTGGCGTC CATTAGGCAGTTGGCGGGGTAACGGCCCACCAAGCCGACGATGGATAGGGGTTCTGAGAGGAAGGTCCCCACATTGG TACTGAAGACGGACCAAATCCTACGGGAGGCAGCAGTGAGGAATATTGGTCAATGGGCGAGAGCCTGAACCAGCCA AGTCGCGTGAAGGATGAAGGTTCTATGGATCGTAACCTTCTTTATAAGGAGAAAGTGTGGGACGGTATCTAAGGAT ATGTACCTTATGAATAAGGATCGGCTAACTCGTGCCAGCAGCCGCGGTAATACGAGGATGCAAGCGTTATCCGGATT TATTGGGTTTAAAGGGTGCGTAGGCGGCCTTTTAAGTCAGCGGTGAAATGCTTGGGCTCAACCCCAAGCCTGCCGTTGA AACTGGGAGGCTTGAGTGTCAGGGAGAACAGCAGTGGCGAAAGCGGTGTGTAGGCGAAAAGCGTTAGATATCACCGGA CGATTGCGAAGGCAGCCATGGAAACAGGATAATCGGCGAACGATTGACGGGGGGCACTGTAAGCGTTAAGCAATATCC CACCTGGGGAGTACGATCGCAAGATTAAACTCAAAGGAATTGACGGGGGCCCGCACAAGCGGAGGAACATGTGGT TTAATTCGATGATACGCGAGGAACCTTACCTGGGCTTGAATGTGACAGACCGACGGTGAAAGCGATGACATCTTCGGACCGTGAC ACAGGTGCTGCATGGCTGTCGTCAGCTCGTGTCGTGAGATGTTGGGTTAAGTCCCGCAACGAGCGCAACCC CTATTGTTAGTTACCATCAGGTTATGCTGGGGACTCTAGCGAGACTGCCGTGCGGAGCTGGAGGAAGGCGGGGATGA CGTCAAATCATCACGGCCCTTATGATCCGGGCTACACACGTGCTACAATGGCGCGTACAACAGGAGAAAGCCGGAATCC TCACAAGCCGGAATCGCTAGTCGGCAATGGGCTGCAACCCGGGCTTCGTGAAGCTGGAATCGCTAGTAACCGCGGATCAGCCATGCCGCGGTGAATACGTTCCCGGGCCTTGTACACACCGCCCGTCAAGCCATGGAAGCCGGGGGTGCCTGAAGTCGGTGACCGCAACCCCGAAAGGGAGCGAGGTAACACAGGTAACAGGTGCCCGGG CAGGGCGAATTGAGGGACTCAGCCGATCGAGGTTGCCGAGGCGATGGACCTAACTCCGAGCAGGGGGATGA GGTACCTGAAGTCGTAACAAGGTAGCCGTACCGGAAGGTGCGGCTGGATCATCAACTAACC |
| Parabacteroides_dist asonis_NB_6_NCBI_AB117561 | Parabacteroides_d istasonis | AB117561 | SEQ ID NO: 277 | AGGATGAACGCTAGCGACACAGGCTTAACACATGCAAGTCGAGGGGCAGCACAAGGGAGCTTGCTCCCGGGCGACCGG CGCACGGGTGAGTAACGCGTATGCAACTTACCTATCAGAGGGGGATAATCCGGAGAAAGTCGACTAATACCGCATGA AGCAGGGATCCCGCATGGGAATATCGCTAAAGATTCATCGCTCATTAGGCAGTTGGCGGGGTAACGGCCCACCAA AGCGACGATGGATAGGGGTTCTGAGAGGAAGGTCCCCCACATTGGTACTGAGACACGGACCAAACTCCTACGGGAGGCAGCAGTGAGGAATATTGGTCAATGGGCGAGAGCCTGAACCAGCCAAGTCGCGTGAAGGAAGACGGCCCTATGGGTTGTAAACTTCTTTTATATATGGGGATAACGGGATAACGGAAGACGGAAGACCGGAGATTATTGGTGATACGACGCCTTTATGGATCAAGGGAAGGGGGGAATGAATAAGGATCGGCTAACTCCGTGCCAGCAGCCGCGGTAATACGAGGATGCAAGCGTTATCCGGATTTATTGGGTTTAAAGGGTGCGCAGGCGGACTGGAGAACCGGAATTGCTTGGGTGTTGCAATCGCTGATATCAAGCCCCTTAAAAGAGAGTTTTAAACAGGAGCGGAATGCGTGGTGTAGCGGTGAAATGCTTAGAGATCACGCAGAACACCGATTGCGAAGGCAGCCTGCTGTTACTGACACAGGATGCAAGCCGAAGGCACCAGCCCCGAAAAGGAAGCAGTTCAACCGATTACTGACCCTTGAGGGACTACAGGGAGCAGGGGCGCCCATGCCGCAAGCCGGAATCGCTAGTCGCGCTGGAACTCCGTTGACACCGTTGACACAGGCAGCACGGGATGAACCCTGCGAAACTTTTAACGGGGGCCCGCACAAGCGCAGCAATCCGCACCAGTGGAGCACACAGTGGCGCGAAGCCAAACACCGCTGACACACTTCCTGGGGGCCAAGGAAGCGGGGATGACGTCAAATCATCACGGCCCTTATGATCCGGGCTACACACGTGTTACAATGGCGTAGGACCAAAGAGAGGGCAGGGAGCGGAAGATACGAGGTTGCCAAGGCGCAATAGGCGAAGCACACACGTCAAGCCATGGAAGGCAGGAGTGCCCGAGGGGAGGTGAGCTGGCGAATCACCCGAAGTCGGTGGATCGAAGAGCCGGGGGG ACCTGAAGTCGGGTGACCGCAACCCCGAAAGGGGGCCTAAGCCGTGTAACAAGGTAGCCGTAYCGTAM |
| Parabacteroides_dist asonis_SaLBE_7_N CBI_JN038566 | Parabacteroides_d istasonis | JN038566 | SEQ ID NO: 278 | GGTAGCAATACCGGGTGCGGACCGGCGCACGGGTGAGTAACGCGTATGCAACTTACCTGTCAGAGGGGATAACCCG GCGAAAGTCGGACTAATACCGCATGAAGCAGGGGGCCCGCATGGGCCCAAAACGCCATCGGTCAGGCAGCGGAGCTCGAACGGCCAACGGCCCAAAACGCCATCGGTCAGGCAGCGGAGCTCGAACG CATGGTTGCCATTAGGCAGTTGGCGGGGTAACGGCCCACCAAACCGACGATGGATAGGGGTTCTGAGAGGAAGGTCCCC CATATTGGTACTGAGACACGGACCAAACTCCTACGGGAGGCAGCAGTGAGGAATATTGGTCAATGGACGGGAGTCTG AACCAGCCAAGTCGCGTGAAGGATGAAGGTCTATGGATCGTAAACTTCTTTTATAAGGAATAAGGTCGGGAAGCGCACACGTGTCGTGT ACGGATTATTGTGTGGGGGCTTAAGGGGAGCAGGGGGCCCAAGGCCATGCCGCGTGAGGTGTGGACGGTGTGTAC AATCGCGTGATATCCGAGCAGGCAGGCTTGAGTGGTGCAGGGAGGCGGAATCGTGGGGGGATCACGGCACACTTGGAG ACGGATTCAGCGGGCCTTTATGGCGGAGAATTGCGGGGAGCACTGTAAGCGTTAAGCAATATCACCG AGAACCCCGATTGCGAAGGCAGCCATGGAAACAGGATAATCACGGGGATCAAACAGGATTA GATACCCTGGTAGTCCACGCAGTAAACGATGATCACTAGCTGTTTGCGATACACTGTTAAGCGGCACAGCGAAAGCGTTA |

FIG. 16AAAAH

| | | | |
|---|---|---|---|
| Parabacteroides_gol dsteinii_NCBI_AY97 4070 | Parabacteroides_g oldsteinii | AY974070 | SEQ ID NO: 279 | AGTGATCCACCTGGGAGTACGCCGGCAACGGTGAAACTCAAAGGAATTGACGGGGGCCCGCACAAGCGGAGGAACA TGTGGTTTAATTCGATGATACGCGAGGAACCTTACCTGGGCTTGAAACGATCGGGGACCGTGGAGTGTCATGGAAACACCTTTCTA GCAATAGCCGTTTGCGACGTGCTGACTAGTTACTACACGGCCCTTACATCAGCAGCGAATCAGCATCTGGTGTCAGCTCGTGTCGTGAGATGTTGGGTTAAGTCCGCATAACGAGC GCAACCCTTGCCACTAGTTACTACACGGCCCTTACATCAGCAGCGAATCAGCATCTGGTGTCAGCTCGTGTCGTGAGATGTTGGGTTAAGTCCGCATAACGAGC GGGATGACGTCAAATCAGGAGGAAGGTGGGGATGACGTCAAGTCCTCATCATCCTGGGTCTAAGGGGACTGCCAGTGATAAACTGGAGGAAGGTG CTGGTAATAACGACCATGGCACCATGATCGGAGCTACCATCGAATACGTTCCCCGGATCGGAGCCCGCGGAGAATCGTGAGGCCATGGATT GCCGGGGGTACCTGAGTCGTAACAAGGTAGCCGTAGGGGAACCTGCGGCTGGATCACCTCCTTA AGCGTCCGGAGCGCGGAACACTCTCTAGAGTGCA |
| Parabacteroides_gor donii_JCM_15724_N CBI_AB470343 | Parabacteroides_g ordonii | AB470343 | SEQ ID NO: 280 | GTCGAGGGGCAGCACGGATGTAGCAATACATTGGTGGCGACCGGCGCACGGGTGAGTAAGCGTATGCAACCTGCCTA TCAGAGGGGAATAACCCGGCGAAAGTCGGACTAATAACCGCATAAAACAGGGGTTCCACATGGTCCACCAAGTCCACGATGGATAGGGGTT TATCGCTGATAGATGCGTTCGATTCCATTAGATAGTTGGTGAGGTAACGGCTCACCAAGTCCACGATGGATAGGGGTTATCGCTGATAGATGCGTTCGATTCCATTAGATAGTTGGTGAGGTAACGGCTCACCAAGTCCACGATGGATAGGGGTT CTGAGGAAGGTCCCCACACTGGTACTGATTACTGGAGACAGGATGCCTACGGGAGGCAGCAGATCTATGGAGAATATTGGTC AATGGGAGAGCCTGAAACCCGTGTCCTTTTGTATGTGAAGGATGAAGGATCATCGGGCTAACAGGATAAAGCCTTAATTAAACGGCCGTAATA AAGTGAGGAACGGTTGCCAGCCGCCGCGGTAATACGGAGGATCCAAGCGTTATCCGGATTATTGGGTTTAAAGGGTGCGTAGGCGGATATATTGGG AAGCGTAAATGCGTTAAACCATATATACGCTAGAGATTGAATTGCAAGTGATCAGTAACGCGAGAGATTGAAGCGGAAAGAGTGAGGAACGCAAAATGCGTAAATGCGTTAAACCATATATACGCTAGAGATTGAATTGCAAGTGATCAGTAACGCGAGAGATTGAAGCGGAAAGAGTGAG ATGCATAGATATACAGCCAGAACTGATTGCAGACTGAAGCTGATAACCGATCAGTAAGCGAGAGAGATGAAAGAGCGTGG GGATCAAACAGGATTAGATACCCTGGTAGTCCACGCCGTAAACGATGATTACTAGCTGTTTGCGATACACAGTAAGCGG CACAGCGAAAGCGTTAAGTAATCCACCTGGGGAGTACGCCGGCAACGGTGAAAACTCAAAGGAATTGACGGGGGCCCGC ACAAGCGGTGGAGCATGTGGTTTAATTCGATGCAACGCGAGGAACCTTACCAGTCTTGACATCCATCAGCAAGCTG GAAACACATTCTCTAATAAGCAATTCTACACAGGTGCTGCATGGTTGTCGTCAGCTCGTGCCGTGAGATGTTGGGTTAAGT CGTCAACGAGCGCAACCCTTATCATTCAGTTACTACACTCAGGGATGCTGAGCACTCCAGTGAGACTGCCAGCACACAGC GTGGAGGAAGGGAGGGGATGACGTCAAATCAGCACGCCCTTACATATCTCCAAACGGCCTGTATACAAAAGGAGGTCAGCG GCATAAAACAGGGGGAATCGGACCTGGTCAAAAGGAGGAAGGTGACGCCGCGCGGCAACCCGTAAACGAGTATACCAAAAGGAGGTCAGCG GTGTGAGGGATGTATAACGCACACGGATATGATTACATTGAGATTACTGCAAGAACAACAGCTGGAAGTCGGAGCACCACCACTCTGGGGAC TGTGAGGCAGCTACCTGCCCAAACCATCTCAAACCCATCAGCATCCGAAATCGGTCGAGTTGGACCGACTCTG AAAGGGCAGCTACCTGCCCAAACCATCTCAAACCCATCAGCATCCGAAATCGGTCGAGTTGGACCGACTCTG TGAAGCCATGGGATTCGTGGGCTCTAGAGTCGGGTACCTTAAGGCGGACAATGCGCTAAAGTCAACGACTCGGACCCATGGGATTCGTGGGCTCTAGAGTCGGGTACCTTAAGGCGGACAATGCGCTAAAGTCAACGACTCGG CAAGCATGGGAGTGGGCAGTACGTTAACGCACTCCGCAAGGATCGGCCTAGG |
| Parabacteroides_gor donii_JCM_15725_N CBI_AB470344 | Parabacteroides_g ordonii | AB470344 | SEQ ID NO: 281 | GAGTTTGATCCTGGCTCAGGATGAACGCTAGCGACAGGCTTAACACATGCAAGTCGAGGGGCACGGGTGAGTGCT AACGCGTATGCAACCTATCCTCATTAGATAGTTGGTAAGCTAACCGGACTAATAACCGCATAAAAGTTGCTGAT AGATGGGCATGGCCCCACACTGGTACTGAGACACGGACCAGAACTCCTACGGGAGGCAGCAGTGGGGAATATTGTACCT GGTCCCCACACTGGTACTGAGACACGGACCAGAACTCCTACGGGAGGCAGCAGTGGGGAATATTGTACCT TATAATTCTTATAAGGTGCTCAGGTGCTCAACCATCAGCCGTGTTATATGAAAGTTTGTGGTCAAAGTTTGGGATTCCTGGCGATTATTGGGCTA TAATAGGTGCTCAGGTGCTCAACCATCAGCCGTGTTATATGAAAGTTTGTGGTCAAAGTTTGGGATTCCTGGCGATTATTGGGCTA ACTTGAGTATATTGAGGGTAGGCGGAATGCGTGGTGTAGCGGTGAAAGTGAGCCATTGGACCATTCAGCGGTTCAA AGGCAGCTACTTGGACCTAGCGAGGGGGATCCAAGTGGCAAGGTTGGGGACGCCGCGCAACTTAGATACCCTGGTAGTCCACGCCG AATAACAGAGTGACTCTAAACGATTAGACCTAGGGGAGATCGGGGGGAATCGTACACGCCGTAAACGACTCGGATGATGATGGATCGGGATGATGATGGATCGGGATGATGATGGATCGGGATGATGATGGATCGGGATGATGATGGATCGGGATGATGATGGATCGGGATGATGATGGATCGGGATGATGATGGATCGGGATGATGATGGATCGGGATGATGATGGATCGGGATGATGATGGATCGGGATGATGATGGATCGGGATGATGATGGATCGGGATGATGATGGATCGGGATGATGATGGATCGGGATGATGATGGATCGGGATGATGATGGATCGGGATGATGATGGATCGGGATGATGATGGATCGGGATGATGATGGATCGGGATGATGATGG CATAACGAGCGCAACCCTTGTCACTAGTTACTAGCATCCGATGCGCGAGATGTTGGGGAGACTGCCAGT GGCCGATGCGCATCAGCGGTTTGAACGCGATAAGGTTAAGCCTGTCCAGATTCGGCGATGCAGTGGGAAGGCT GTAGGCATCCACTGGTACACCTTGTCACTAGTTACTAGCATCCGATGCGCGAGATGTTGGGGAGACTGCCAGT AATCGCGCATAGCAATCGCATGGGGATGGTGGATCGGGTGCTCAAAGCGGGTCAAGTCGGGAATCGCTAGTAATCGCGCATAGCAATCGCATGGGGATGGTGGATCGGGTGCTCAAAGCGGGTCAAGTCGGGAATCGCTAGTA ACCGTAAACGAGCGCAACCCTTGTCACTAGTTACTACACTCAGGGATGCTGAGCACTCCAGTGAGACTGCCAGT GTACCTAAGTCCGGTATCGGGATGAAGTCGGTAACAAGGTAGCCGTACGGGGAATGATATTGGTCAATGGGCGAGAG GGTCCCCCCACTGGTACTGAGACACGGACCAGACTCCTACGGGAGGCAGCAGTGGGAATATTGGTCAATGGGCGAGAG |

FIG. 16AAAAI

| | | | |
|---|---|---|---|
| Parabacteroides_joh nsonii_DSM_18315_ NCBI_ABYH0100000 14 | Parabacteroides_j ohnsonii | ABYH01000001 4 | SEQ ID NO: 282 | AGCCTGAACCAGCCAAGTCGCGCTGAAGGATGAAGGATGAAGGATTATGTGGTTCGTAAACTTCTTTTATAAGGGAATATGTATGTACCT TATGAATAAGGATCGGTAACCTGTCCGTGCCAGCAGCCGCGGTAATACGGAGGATCCGAGCGTTATCCGGATTTATTGGGT TTAAAGGGTGCGTAGGTGGTTTATTAAGTCAGAGGTGAAATGCCGGTGAAGTTGTGGCTCAACCATAAAATGCCGTTGAAACTGGTTA ACTTGAGTATATTTGAGGTGGAAGTGCGGTGGCGGAATGCGTGGTGTAGCGGTGAAATGCATAGATATCACGGAGAACACCGA AGGCAGCTTACTAAACTGATGACACTGAGGCACGAAAGCGTGGGGAGCAAACAGGATTAGATACCCTGGTAGTCCACG CAGTAACGATGATTACTCGTCGCGTCCGAAGGCAAACACCGAAAGCGTTCCGGCCTGGGGAGTACGGCCGCAAGGCTAAAACTCAAAGGAATTGACGGGGCCCACACAGCGG GAACCTTACCCGGGTTTGAACGCGAGGAACCTTACCTGCCAGAGTCGTGCGGTGTCTGGCTTAAAGACTGCCAGCTCAAGGCTGAGGGTGGCTTAAGAGTCACGAAAGCGACTGCGAAGGT CATAACGAGGCGACCGATCTTTTAGTTACTAACACGATTGCTAACAGCTGTTACAATGGATAGCCTAAAAGAGACTAATGGTCGGGCAAAGGCTGAAGGAAG TGGGAGTGCGTCGAAACCTTCTCCTTACCTTACCGATTCAGGTTCAGGCTGGACGTGAAGCTGGAATCGCTGCTTACAGCTGCAGCGACGGATAAGCGGTAAGGGAGTGGAATTGGCAATAGCGG CAAGTGCAATCATGTAAGCTGGCGTGTTGTGCAATGGATGCGAAGCAGCCTGGAGAAATCGACGTGGATCGCGTGATGATCCAACTCGGGTTCGTGAACGTGCGGTGAATACGTTCCGGGCCTTGTACACACCGCCCCGTCACACCGGGAGTTGTGACGAAGAGTCGTAACAAGGGTAACC GTACCTAAAGTCCGTATCGGCCTATGGGCCTATGCTAATGCGGCATCTAAACCCATATGCTAAACGATTGACTCCACTCACCGAAGT |
| Parabacteroides_me rdae_ATCC_43184_ NCBI_AB238928 | Parabacteroides_ merdae | AB238928 | SEQ ID NO: 283 | ACAACGAAGAGTTTGATCCTGGCTCAGGATGAACGCTAGCGGACAGGCTTAACACATGCAAGTCGAGGGGCAGCATGT AAGTAGCAATACTTATTGATGGCGACCGGCGCACGGGTGAGTAACGCGTATGCAACTTACCTATCCAGAGGGGATAGCC CGGCGAAAGTCGGATTAATACTCCATAAAACAGGGGTTCCGCATGGGAATCGCCCAGGCGGTGGATCGCGTAAGATAG GCATGCGTTCCATTAGGCAGTTGGCGGGGGTAACGGCCCACCAAGCCCACCAAGCCCGATGGAATGGGAGCCGATATTGGTTCAATGGCGAGAGGCT CCCACATTGGTACTGAGACACGGACCAAACTGCAGGAGGCGGCAGCGGCCACAATCCGCCACAGGGTTAGGCTACCGGCACAGAGGTGAGAGCT GAACCAGCCAAGTCGCGTGAAGGATGAAGGATTAAGGGATCGGCTAACTATCTGGGCTAGGTGGAATAAAAGGTCTATGGGCTAACTCAACACCTTGGAATGGAGCTGTAAAGCTTGTAAAACTTCTTTATAGGGAATAACGGGCCGTAATACGCCGTGAAAGTTTGTGGCTCAAGCCCATTAAATA TGCCGTTGAAACTGGTTACCTTGAGTATACTTGAGGTGGGAGAAATAGGTGCAATGTAGCGGTGAAATGCATAGATATCAC GCAGAACTCCAATGCGAAGGCAGCTTACTAAACTATAACATATACCGTACACCGTACACTGAGACGACGAAAGCGTGGTATCAAACAGGATT AGATACCCTGGTAGTCCACGCCGTAAACGATGATTACTAGGATTGCGAAGGACACCGGCCCTTGTACACACCGCCCGTCAAGCCATGGGAGTGGGGAGTGCCCTTGTACACACCGCCCGTCAAGCTCGCCGTCAAGCTCGGGCTTGTGGGACTACCGAAGT CACCTTACCTGTTTAATTCAGGTTCAGGTTCAGGTTCATCGACCCCGCAGCACCGCAACAGACCGTAACATGGAGCTCCCCATATGCGGAGTAATACGTTCCCGGGCCTTGTACACACCGCCCGTCAAGCCATGGGAGTTGGGAGTGCCCTTGTACACACCGCCCGTCAAGCCATGGGAGTTGGGAGTTGGAGCAACGC |

FIG. 16AAAAJ

| | | | |
|---|---|---|---|
| Parabacteroides_me rdae_B13_NCBI_EU 722738 | Parabacteroides merdae | EU722738 | SEQ ID NO: 284 |
| Parabacteroides_me rdae_JCM9497_NC BI_EU136685 | Parabacteroides merdae | EU136685 | SEQ ID NO: 285 |
| Parabacteroides_sp _D13_NCBI_ACPW0 1000017 | Parabacteroides_s p_D13 | ACPW0100001 7 | SEQ ID NO: 286 |

FIG. 16AAAAK

| | | | |
|---|---|---|---|
| Parabacteroides_sp_NS31_3_NCBI_JN029805 | Parabacteroides_sp_NS31_3 | JN029805 | SEQ ID NO: 287 | TCCGGATTTATTGGGTTTAAAGGGTGCGTAGGCGGCCTTTAAGTCAGGGGTGAAAGTCTGTGGCTCAACCATAGAATT<br>GCCGTTGAAACTGGGAGGCTTGAGTATGTTTGAAGGCAGGCGGAATTCCTGGTGTAGCGGTGAAATGCGTAGATATCAC<br>GCAGAACACCGATTGCGAAGGCAGCCTGCTGGAACACGATGACTGACGCTGAGGCACGAAAGCGTGGGGATCAAACAGGAT<br>TAGATACCCTGGTAGTCCACGCGGGAGTGATGATGGTAAACGATGATCACTAGCTGTTTGCGATACACTGTTAAGCGGCACAGCGAAAGCGT<br>TAAGTGATCCACCTGGGGAGTGATGATGGTAAACGATGATCACTAGCTGTTTGCGATACACTGTTAAGCGGCACAGCGAAAGCGAAA<br>CATGTGGTTAATTGACGATGATACGCGAGGAATACCCTTACCCGGGCTTGAACGCATTCAAAGAATGCAAAAGTCCATAACGAG<br>AGCAACCCTTGCCACTATTGACCTGGAGCTGGGGGCATGCAGGTGTCGTCGTCAAGGATGTTCGGGTTTAAGTGCCATAACGAG<br>CGCAACCCTTGCCACTATTGACAATCAGCAGCGGACACAGCGAATCAGCGAATACGCTGATACATCCGAGGGAAGCCTTGCCACTATTGACCTCAGTGCAGGGAATATGCGAATATGCGACAGGTGTTACAATGGGCAGTATACAA<br>CCTGGGCACAGGAGGGCGCCGGTGGGAATCAGCGAATCGGGATCAGCAGTTGGATAATGGTTGCGCCCCAAATGGCGCCAATGCAAAAGGGAGGGCA<br>AGCCGCGAGGTACCTGAGCCAATTCGATGACACCACGCCAAGGTAAAATCTGGAACTCGTACAATGGGCAGTATACAAA<br>GTAGCCGTACCGGAAGGTGCGGCTGGAACACCAGCCATGCACCTCT |
| Peptostreptococcus_anaerobius_653_L_NCBI_ADJN01000055 | Peptostreptococcus_anaerobius | ADJN01000055 | SEQ ID NO: 288 | AGAGTTTGATCCTGGCTCAGGATGAACGCTAGCGGACAGGCTTAACACATGCAAGTCGAGGGGCAGCATAGAAGTAGCAA<br>TACTTTGGTGGTGCCGACCGGCGACCTAAGTGCAACATGCAAGTCGAGGGGCAGCATAGAAGTAGCAA<br>CGGACTAATACCGCATAAAACAGGGGAACGCATAAGCTATCAGAGGGAATAACCGGCGAAAGTCGGGCATGCGTTC<br>CATTAGTTAGTTGGTGGGGTAACGGCCCTACCAAGGCAACGCCTGATGGCAGATGCGGCAGATGAGCAGCGCGCAAGCGGCCCAACTGG<br>TACTGAGACACGGACCAGACTCCTACGGGAGGCAGCAGTAGGGAATATTGTCAATGGGCGAAAGCCTGATGGCAGCAACAGCCA<br>AGTCGCGTGAAGGAAGAAGGATCGGATCGATCCTAACACGGCAATGGCGGACGGGGGCGCAAGCCGTATCCGGAT<br>TATGTACCCTGAGAATAAGGGTGCGTAGGTGGTTGCGCAAGTCAGCGGTGAAATTGCAGCTTAACTGCTGAAATGCCGTTGAAATGCCGTTGAAATGCCGTTGA<br>AACTGTCGAACTTGAGTGCAAGAGAGGAAAGGTGGAATTCCAGGTGAAATACCGAGAGTGAAATCCAAAAGGCGAGCTGAAATGCCGTTGAAATGCCGTTGAAATGCCGTTGAAATGCCGTTGA<br>CGATTGCGAAGGCAGCCTTCTGGACGTGATGAGTAATAAACGATCGAAGCAACAGTGTGGAGAGGAACAGTGTGGAGAGCGCAACCCT<br>GGTAGTGCCACGCAGCCTAAACGATGATTACTAGCTGTTTGTGCGATACAATGCAGCGAAGAGCTAAGCGATTAGATACCCT<br>ACCTGGGGAGTACGGCGCAACGCGAAGAACCGAAGCTTAAAAACTCAAAGGAATTGACGGGGACCCGCACAAGCGGTGGAGCATGTGGTTTA<br>ATTCGATGATAACGCGAGGAACCTTAACCGGGGTTGACATATCGGGAACGCGAAGACGCGAAGCATGTGGTTTA<br>ATTCGAAGGGCAGCAGTGAGCTCAGCCTGTCGTGAGACTCTAACGGCCAGCAGTACGGAGAGCTCAGCCTGTCGTGAGATGTGAGGAAGGTGGGAGCAGCAGCAAAGCCCAA<br>ATTCCAGTGTTACTACAGGTGATGCTGAAGCCAGCTGCAACGCGAAGAACGATTAGATACCCT<br>GGTAGTCCACGCAGTACGCGAACCTTCTAAACCTTATCTCAAAGGAATTGACGGGGACCCGCACAAGCGGTGGAGCATGTGGTTTA<br>ATTCGAAGATGAACGCGAGGAAACCTTACCGGGGTTGACATATCCATGGATAACGCGAGAGCAGCAAACCGAGAGGAGGAAGGTGGAGACTCCAACGCA<br>GGAGCATCAGCCATGCCGGGTAAGCGTAAGCATGCCCCCGTCAAGCATGCCAACGAGCTGCGACCAACAGCGAGGAGCAGCAGCAAACATGTGGGCCCGCACAAGCGG<br>CCTGAAGTTCGTAAGCGGTAAGGATGCAGCTGACCTAAGGGTTTACTAGTACTGGCGCGTGACAGTGGCTAAGCGGTAAGCCTGCAACCGTTGGG<br>AGGGGACGACGGTGACACTACGCGATAACGCAGCCATGACGCGAGGCATGGCCACATTGCAACCCAACCCAGCAGCTGAAACAACATGCCAACAGCGCTGA<br>ATATATAACTGCCCCGACCAAGCGACAGCCATCGAACCATGCGCCGTGCTCAACGATGAAAGTTTACTAATACATG<br>GAGATAACTGCCCCTACGGGAGGAGGCAGCATGCGTCCGGCAACCGGTCAAATGTAACGACATTTACTAATACATG<br>CAAACTCCTACGGGGAGGCAGCAGTCGGGAATATTGCACAATGGGCGCAAGCCTGATGCAGCGCATCGAAGCAACGACGCAGCTGAAACAACCGGTC<br>GAAGGTCTTCGGATCTGTAAAGTCTGTTGTGCAGGGGAAGAAGCGCCGGGCTAACTACGT<br>GCCAGCAGCCGCGGTAAATACGTAGGGGGCAAGCGTTGTCCGGATTTTATTGGGCGTAAAGGGTGCGTAGGTGGTCCTTTT<br>AGTCGGTGGTTAAAGGCTACGGCTAAGGCTACGCTCAACGTAGATATTGGCGGTAGATATTGGGGACTGGAAAGACTTGAGTGCAGCGAGCCAGCAGCAGGATTAGATACCCT<br>GAATTCCCAGTGTAGCGGTGAAATGCGTAGATATTGGGGACTGGGAACACCAGTGGCGAAGGCGGCTAGGGACTGAGTAGTGA<br>ACACTGAGGCACGAAGGCGAAAGCGTGGGGAGCAAGCAGGATTAGATACCCTGGTAGTCCACGCGTAAGCATGATGCGAGTACTCAACGCCA<br>GTCGGGGCACCGCAGGAACTGATTTCGGAGCTAAAGCCGGTGGCGAAGCGGCTAGGGACTGAGTAGTAGAT<br>GAACGAATTGACGGGGCCCGCACAAGCGGTGGAGCATGTGGTTTAATTCGAAGCAACGCGAAGAACCTTACCTAAG<br>CTTGACATCCCTTAGACGCTAGAGATATAGCTTCCTTGGGGCAACTTAGAGATAGGGGACTTAGTGCAGGTGGTGCATGGTTGTCGTCAG<br>CTCGTGTCGTGAGATGTTGGGTTAAGTCCCGCAACGAGCGCAACCCTTGTCTTTATGTCAGCATTCAGTTGGGCACT<br>TCAAAGGAATTGACGGCGGATAACCTAGAGGATGGGGTTGCCAAACCTGGCACCAAAGGTGGAGCAACGTGCAAGTCAGCAAAC<br>CTGACATCCCTTAGACGCTAGAGATATAGCTTCCTTGGGGACTCAGTGGGACTTAGTGCAGGTGGTGCATGGTTGTCGTCAG<br>CTCGTGTCGTGAGATGTTGGGTTAAGTCCCGCAACGAGCGCAACCCTTGTCTTTATGTCAGCATTCAGTTGGGCACT<br>CACGAGCTACAATGGGGATGCAGGGATAACCTAGAAGCAGCAATCAACCATCATCGAAGCCCAGCGAGCTAATCCCTTAAAGCCATTCAGTTCGGATTGCAGG<br>TTGTAGGCTGCAACTCGCCTACATGAAGTCGGAATCGCTAGTAATCGCGGATCAGAATGCCGCGGTGAATGCGTTCCCG |

FIG. 16AAAAL

| | | | | |
|---|---|---|---|---|
| | | | | GGTCTTGTACACACCGCCCGTCACACCATGGGAGTCGGAAACACCCGAAGCCGATTATCCAACCGCAAGGAGGAAGTCGTCGAAGGTGGCGTCGATAACTGGGGTGAAGTCGTAACAAGGTAGCCGTATCGGAAGGTGCGGCTGGATCACCTCCTTTCT |
| Peptostreptococcus_anaerobius_NCTC_11460_NCBI_AY326462 | Peptostreptococcus_anaerobius | AY326462 | SEQ ID NO: 289 | GATGAACGCTGGCGGCGTGCCTAACACATGCAAGTCGAGCGCGTCTGATTTGATGCTTGCATTNATGAAAGATGAGCGGCGGACGGGTGAGTAACGCGTGGGTAACCTGCCCTATACACATGGATAACATACTGAAAAGTTTACTAATACATGATAATATATATTTACGGCATCGTAGATATATCAAAGTGTTAGCGGTATAGGATGGACCCGCGTCTGATTAGCTAGTTGGTGAGATAACTGCCCACCAAGGCGACGATCAGTAGCCGACCTGAGAGGGTGATCGGCCACATTGGAACTGAGACACGGTCCAAACTCCTACGGGAGGCAGCAGTGGGGAATATTGCACAATGGGCGCAAGCCTGATGCAGCAACGCCGCGTGAACGATGAAGGTCTTCGGATCGTAAAGTTCTGTTGCAGGGGAAGATAATGACGGTACCCTGTGAGGAAGCCCCGGCTAACTACGTGCCAGCAGCCGCGGTAATACGTAGGGGGCTAGCGTTATCCGGATTTACTGGGCGTAAAGGGTGCGTAGGTGGTCTTTCAAGTCGGTGGTTAAAGGCTACGGCTCAACCGTAGTTAGCCTCCGAAACTGGAAGACTTGAGTGCAGGAGAGGAAAGTGGAATTCCCAGTGTAGCGGTGAAATGCGTAGATATTGGGAGGAACACCAGTAGCGAAGGCGGCTTTCTGGACTGCAACTGACACTGAGGCACGAAAGCGTGGGTAGCAAACAGGATTAGATACCCTGGTAGTCCACGCTGTAAACGATGAGTACTAGGTGTCGGGGGTTACCCCCCTCGGTGCCGCAGCTAACGCATTAAGTACTCCGCCTGGGGAGTACGCACGCAAGTGTGAAACTCAAAGGAATTGACGGGGACCCGCACAAGTAGCGGAGCATGTGGTTTAATTCGAAGCAACGCGAAGAACCTTACCTAAGCTTGACATCCCTTAGACCGGTGTTTAATCACACCTTCCCTTCGGGGCTGAGGTGACAGGTGGTGCATGGTTGTCGTCAGCTCGTGTCGTGAGATGTTGGGTTAAGTCCCGCAACGAGCGCAACCCTTGTCTTTAGTTGCCAGCATTCAGTTGGGCACTCTAGAGAGACTGCCAGGGATAACCTGGAGGAAGGTGGGGATGACGTCAAATCATCATGCCCCTTATGCTTAGGGCTACACACGTGCTACAATGGGTGGTACAGAGGGTTGCCAAACCGTGAGGTGGAGCTAATCCCTTAAAGCCATTCTCAGTTCGGATTGTAGGCTGAAACTCGCCTACATGAAGCTGGAGTTACTAGTAATCGCAGATCAGAATGCTGCGGTGAATGCGTTCCCGGGTCTTGTACACACCGCCCGTCACACCATGGGAGTCGGAAACACCCGAAGCCGATTATCCAACCGCAAGGAGGAAGTCGTCGAAGGTGGCGTCGATAACTGGGGTGAAGTCGTAACAAGGTAGCCGTATCGGAAGGTGC |
| Peptostreptococcus_stomatis_DSM_17678_NCBI_ADGQ01000048 | Peptostreptococcus_stomatis | ADGQ01000048 | SEQ ID NO: 290 | CTGAGCAAAACCAAGCGGCGGACGGGTGAGTAACGCGTGGGTAACCTGCCCTATACACATGGATAACATACTGAAAAGTTTACTAATACATGATAATATATATTTGCGGCATCGCAGATATATCAAAGTGTTAGCGGTATAGGATGGACCCGCGTCTGATTAGCTAGTTGGTGAGATAACTGCCCACCAAGGCGACGATCAGTAGCCGACCTGAGAGGGTGATCGGCCACATTGGAACTGAGACACGGTCCAAACTCCTACGGGAGGCAGCAGTGGGGAATATTGCACAATGGGCGAAAGCCTGATGCAGCAACGCCGCGTGAACGATGAAGGTCTTCGGATCGTAAAGTTCTGTTGCAGGGGAAGATAATGACGGTACCCTGTGAGGAAGCCCCGGCTAACTACGTGCCAGCAGCCGCGGTAATACGTAGGGGGCTAGCGTTATCCGGATTTACTGGGCGTAAAGGGTGCGTAGGTGGTCCTTCAAGTCGGTGGTTAAAGGCTACGGCTCAACCGTAGTAAGCCGCCGAAACTGGAGGACTTGAGTGCAGGAGAGGAAAGTGGAATTCCCAGTGTAGCGGTGAAATGCGTAGATATTGGGAGGAACACCAGTAGCGAAGGCGGCTTTCTGGACTGCAACTGACACTGAGGCACGAAAGCGTGGGTAGCAAACAGGATTAGATACCCTGGTAGTCCACGCTGTAAACGATGAGTACTAGGTGTCGGGGGTTACCCCCCTCGGTGCCGCAGCTAACGCATTAAGTACTCCGCCTGGGGAGTACGCACGCAAGTGTGAAACTCAAAGGAATTGACGGGGACCCGCACAAGTAGCGGAGCATGTGGTTTAATTCGAAGCAACGCGAAGAACCTTACCTAAGCTTGACATCCCTCGGACAGGTGTTTAATCACACCCTTCCTTCGGGACTGAGGTGACAGGTGGTGCATGGTTGTCGTCAGCTCGTGTCGTGAGATGTTGGGTTAAGTCCCGCAACGAGCGCAACCCTTGTCTTTAGTTGCCAGCATTCAGTTGGGCACTCTAGAGAGACTGCCAGGGATAACCTGGAGGAAGGTGGGGATGACGTCAAATCATCATGCCCCTTATGCTTAGGGCTACACACGTGCTACAATGGGTGGTACAGAGGGTTGCCAAACCGTGAGGTGGAGCCAATCCCTTAAAGCCATTCTCAGTTCGGATTGTAGGCTGAAACTCGCCTACATGAAGCTGGAGTTACTAGTAATCGCAGATCAGAATGCTGCGGTGAATGCGTTCCCGGGTCTTGTACACACCGCCCGTCACACCACGGGAGTCGGAAACACCCGAAGCCGATTATCCAACCGCAAGGAGGAAGTCGTCGAAGGTGGCGTCGATAACTGGGGTGAAGTCGTAACAAGGTAGCCGTATCGGAAGGTGCGGCTGGATCACCTCCTTTCT |
| Porphyromonadaceae_bacterium_NML_060648_NCBI_EF184292 | Porphyromonadaceae_bacterium_NML_060648 | EF184292 | SEQ ID NO: 291 | CAGGCTTAACACATGCAAGTCGAGGGACCGGCGCACGGGTGAGTAACGCGTATGCAACCTACCTATCAGAGGGGAATAACCCGGCGAAAGTCGGACTAATACCGCATAAATAAAGTCGCTGATAGATGGGCATGCGTTCCATTAGGTAGTTGGTGAGGTAACGGCTCACCAAGCCGACGATGGATAGGGGAACTGAGAGGTTGGTCCCCCACACTGGTACTGAGACACGGACCAGACTCCTACGGGAGGCAGCAGTGAGGAATATTGGTCAATGGGCGGGAGCCTGAACCAGCCAAGTCGCGTGAAGGAAGAAGGATTATGGTTCGTAAACTTCTTTTGCAGGGGAATATGTATGTACCCTGAGAATAAGGATCGGCTAACTCCGTGCCAGCAGCCGCGGTAATACGGAGGATCCGAGCGTTATCCGGATTTATTGGGTTTAAAGGGTGCGTAGGTGGTTTGATAAGTCAGCGGTGAAAGTTTGCAGCTTAACTGTAAAAATGCCGTTGAAACTGTCGGACTTGAGTGTAAATGAGGTAGGCGGAATGCGT |

FIG. 16AAAAM

| | | | |
|---|---|---|---|
| Pseudoflavonifractor_capillosus_DSM_23940_NCBI_AY13666 6 | Pseudoflavonifractor_capillosus | AY136666 | SEQ ID NO: 292 |
| Pseudoramibacter_alactolyticus_NCBI_AB036759 | Pseudoramibacter_alactolyticus | AB036759 | SEQ ID NO: 293 |

(Sequence data for SEQ ID NO: 292 and SEQ ID NO: 293 shown in table cells.)

FIG. 16AAAAN

| | | SEQ ID NO: | |
|---|---|---|---|
| Roseburia_faecis_M 72_1_DSM_16840_ NCBI_AY305310 | Roseburia_faecis | AY305310 | SEQ ID NO: 294 | GATGAACGCTGGCGGCGTGCTTAACACATGCAAGTCGAACGAGTCGGCGGACGGGTGAGTAACGCGTGGGTAACCTGC CTCATACAGGGGGATAACAGTTGGAAATGACTGCTAATACCGCATAAGCGCACAGGACCGCATGGTCCGGTGTGA TTAGCCAGTTGGCGGGATAAGGCCTACCAAGGCGACGATCAGTAGCCGACCTGAGAGGGTGACCGGCCACATTGGGA CTGAGACACGGCCCAAAGTAGTATTCCGGGAATATTGCACAATGGGCGAAAGCCTGATGGAGCAACGCCG CCGCGTGAGCGAAGAAGCTCAGCAGCTGTAAAGCTCTTTCGGTGTCAATCGGGAGGAAGGCGGTTACTGGTGAAAGACTTTGCGG CTAAATACGTGCCAGCAGCCGCGGTAATACGTATGGTGCAAGCGTTATCCGGATTTACTGGGTGTAAAGGGAGCGCAG GCGGTGCGGCAAGTCTGATGTGAAAGTCGGGGGCTCAACCCCGGGACTGCATTCGAAACTGTCGTACTAGAGTGTCGG AGGGGAAGTGGAATTCCTAGTGTAGCGGTGAAATGCGTAGATATTAGGAGGAACACCAGTGGCGAAGGCGGCTTACT GGACGAACTGACGCTGAGGCTCGAAAGCGTGGGGAGCAAACAGGATTAGATACCCTGGTAGTCCACGCCGTAAACGAT GAATACTAGGTGTCGGGGAGCAAACTCTTCAGTGCCGCAGCTAACGCAATAAGTATTCCACCTGGGGAGTACGTTCGCAAGAATGAA ACTCAAAGGAATTGACGGGGGACCCGCACAAGCGGTGGAGCATGTGGTTTAATTCGAAGCAACGCGAAGAACCTTACCAA GTCTTGACATCCTGCGACCGTTGTAGAGATACAACTTTCCCTTCGGGGGCACGAGTACAGGTGGTGCATGGTTGTCG TCAGCTCGTGTCGTGAGATGTTGGGTTAAGTCCCGCAACGAGCGCAACCCCTACTGTTAGTTGCCAGCATTAAGTTGGGCA ACCCTGTCCTCAGTTGCCAGCAGTCAATGACAGGTGGTGCATGGTTGTCGTCAGCTCGTGTCGTGAGATGTTGGGTTAAGTCCCGCAACGAGCGCAACCCTATGGTCAGTTACTACGGCAAGAGGACTCTGGCCAGACTGCCGTTGAC AAAACGGAGGAAGGTGGGGATGACGTCAAATCATCATGCCCCTTATGATCTGGGCTACACACGTGCTACAATGGGCGCA GTCAAAGGAATCATGAAGCCCGCGAGCTACATCTTTAAAACGCATGAATGGAAGCAAGTCTAATACAGAGCAAGCGCAGCGAGAGTAATCAGCTCCACACATCCGGGCTGATGAATCATGCAAGAAGCAATCACCATGGAGTCTGATCAACGCCG ATCGAATCGTAGGTGAACCCGCAAGGGCAACGTAACTCCAGTTCAATAATCCTATCAATGCTGAGAGGAGCAAACATCGATAATCCATATTAT CAGTGACCCAGCAGCAGCCTCCAGTTCGGAGTACAGGAGTGAATACGTTCCCGGGCCTTGTACACACCGCCCGTCACACCATGGGAGTTGGGTAATACCCGAAGTCAGTGAGCTAACCGCAAGGAGGCAGCCGCCGAAGGTGGGATTGATGACTGGGGTGAAGTCGTAACAAGG TAGCCGTACCGGAAGGTGCGGCTGGATCACCTCCTT |
| Roseburia_intestinali s_L1_82_DSM_1461 0_NR_027557 | Roseburia_intestin alis | NR_027557 | SEQ ID NO: 295 | TTGATCCTGGCTCAGGATGAACGCTGGCGGCGTGCTTAACACATGCAAGTCGAACGAAGCACTTTATTGATTCTTCGG AATGAAGATTTTTGTGACTGAGTGGCGGACGGGTGAGTAACGCGTGGGTAACCTGCCTCATACAGGGGGATAACAGTTG GAAACGACTGCTAATACCGCATAAGCGCACAGGGTCGCATGACCTGGTGTAAAAACTCCGGTGGTATGAGATGGACC CGCGTCTGATTAGCTAGTTGGTGGGGTAAAGGCCTACCAAGGCGACGATCAGTAGCCGACCTGAGAGGGTGATCGGCC ACATTGGGACTGAGACACGGCCCAAACTCCTACGGGAGGCAGCAGTGGGGAATATTGCACAATGGGCGAAAGCCTGAT GGAGCAACGCCGCGTGAGTGAAGAAGTATTCGGTATGTAAAGCTCTATCAGCAGGGAAGAAAATGACGGTACCTG ACTAAGAAGCACCGGCTAAATACGTGCCAGCAGCCGCGGTAATACGTATGGTGCAAGCGTTATCCGGATTTACTGGGTG TAAAGGGAGCGCAGGCGGTGAAGGCAAGTTGGAAGTGAAATCCTATGGCTCAACCATAGTTCGCTTTCCAAACTGTCTT GACTAGAGTGTCGGAGGGGTAAGTGGAATTCCTAGTGTAGCGGTGAAATGCGTAGATATTAGGAGGAACACCAGTGGC GAAGGCGGCTTACTGGACGATTACTGACGCTGAGGCTCGAAAGCGTGGGGAGCAAACAGGATTAGATACCCTGGTAGT CCACGCCGTAAACGATGAATACTAGGTGTCGGGGAGCAAGCTTTCCGTGCCGCAGCTAACGCAATAAGTATTCCACC TGGGGAGTACGTTCGCAAGAATGAAACTCAAAGGAATTGACGGGGGACCCGCACAAGCGGTGGAGCATGTGGTTTAATTCGAAGCAACGCGAAGAACCTTACCAAGTCTTGACATCCCGATGACCGCAGGGTAACCCTGTCCTTCCTTCGGGACATCGGTG ACAGGTGGTGCATGGTTGTCGTCAGCTCGTGTCGTGAGATGTTGGGTTAAGTCCCGCAACGAGCGCAACCCCTATTCT TAGTAGCCAGCAGGTTAAGCCGGGCACTCTAAGGAGACTGCCAGGGATAACCTGGAGGAAGGTGGGGATGACGTCAAA TCATCATGCCCCTTATGATCTGGGCTACACACGTGCTACAATGGCGTAAACAAAGAGAAGCGACCTCGCGAGGGCAAG CAAATCTCAAAAATAACGTCTCAGTTCGGATTGTAGTCTGCAACTCGACTACATGAAGCTGGAATCGCTAGTAATCGCGGATCAGCATGCCGCGGTGAATACGTTCCCGGGCCTTGTACACACCGCCCGTCACACCATGGGAGTTGGGTAATGCCCGAAG TCAGTGACCCAACCGTAAGGAGGGAGCTGCCGAAGGCGGGACCGATAACTGGGGTGAAGTCGTAACAAG |
| Roseburia_intestinali s_XB6B4_NCBI_FP 929050 | Roseburia_intestin alis | FP929050 | SEQ ID NO: 296 | AGAGTTTGATCCTGGCTCAGGATGAACGCTGGCGGCGTGCTTAACACATGCAAGTCGAACGAAGCACTTTATTGATTTC TTCGGAATGAAGATTTTTGTGACTGAGTGGCGGACGGGTGAGTAACGCGTGGGTAACCTGCCTCATACAGGGGGATAAC AGTTGGAAACGACTGCTAATACCGCATAAGCGCACAGGACCGCATGGTCCTGTGTGTGAAAAACTCCGGTGGTATGAGATG GACCCGCGTCTGATTAGCTAGTTGGTGAGGTAACGGCCCACCAAGGCGACGATCAGTAGCCGACCTGAGAGGGTGACC GGCCACATTGGGACTGAGACACGGCCCAAACTCCTACGGGAGGCAGCAGTGGGGAATATTGCACAATGGGGGAAACCC TGATGGCACAATTGGGACTGAGCAACGCCGCGTGAGTGAAGAAGTATCGGTATGTAAAGCTCTATCAGCAGGGAAGAAAATGACGGTAC CTGACTAAGAAGCACCGGCTAAATACGTGCCAGCAGCCGCGGTAATACGTATGGTGCAAGCGTTATCGCAGGATTTACTGG GTGTAAAGGGAGCGCAGGCGGTCGGAAGGTGTCTGAGTGCTATCCTAGTGCCTAGTGAATGCGTAGATATTAGGAGGAACACCAGTG GCGAAGGCGGCTTACTGGACAGTAAGCAGTGGTAACGCTGCCGGAGGACCACCAGATTAGATGAATAGGGAAGCGTGGGAGCAAACAGGATTAGATACCCTGGTAG TCCACGCCGTAAACGATGATGCTAACTGTCGGGCAGCAAAGCTGTGCAGCTAACGCGTTAAGCATCCCCACCTGGGGAG TACGCCGGCAAGGTCGAAACTCAAAGGAATTGACGGGGACCCGCACAAGCGGTGGAGCATGTGGTTTAATTCGAAGCAACGCGAAGA ACCTTACCAAGGCTTGACATCCCGATGACCGCTCTTAGAGATAAGGCAAGAGCCTTCGGGACATCGGGTGACAGGTGGTG CATGGTCGTCAGCTCGTGTCGTGAGATGTTGGGTTAAGTCCCGCAAGCGAGCGCAACCCTATTGCTAGTATATTCCAG CCAGAAGCCGGGACTCTAAAGAGACTGCCGGAGACAACCCGGAGGAAGGTGGGGATGACGTCAAATCATCATGCCCCTTA CCTGGGTTCTGCATGCATACGACCTGCGTCTTCCTTCGGGGACCCCAAGCGCTGCATGCGCCACCAGCCGCGGTAATACGTCTGTTA |

FIG. 16AAAAO

| | | | |
|---|---|---|---|
| Roseburia_inulinivorans_DSM_16841_NCBi_AJ270473 | Roseburia_inulinivorans | AJ270473 | SEQ ID NO: 297 | TTGATCCTGGCTCAGGATGAACGCTGGCGGCGTGCTTAACACATGCAAGTCGAACGAAGCACTTTTACAGATTTCTTCGGAATGAAGTTTTAGTGACTGAGTGGCGGACGGGTGAGTAACGCGTGGGGGATAACCGCTCACACAGGGGGATAACAGTTGGAAACGACTGCTAATACCGCATAAGCGCACAGTGCTTGCATGGGACAATGTGGAAAATCGGGAGAGGAACCGGCTTTAGATTAGGCTTTGGCGACGGACCGGCGGTGCCCTGATAGTAGATCATCATGGGACCTGGTACCGGGAAGATACCGCCATGGGGAACAATGGGACCCTGCGGCAGCAATGGGGAATATTGCACATTGGAACGCTCCAATATTGTGGAAATCTTCGGCACTAAGACCGGGATGCTCCACCGGGAAGAAACCATCTGTCGGCATTCCGCAACCTCCACGCGGAAAGGCCGAGCATTCAAAGGAAGACCGGGGAAACGCCAAGCTAATACCGGATAGGGGCAAAGCGAGATTGAAATAAAGCCGAAGAAGAGCTATAATCCTCGGCTGGTCGCCTCGAGAAAACCGGTTGAGCAGGCTGGAATACCCCCAAACCCGAGTGCCGCTCCGAAGGCGCCCCAAGCAAGCGATAGCGACCAGCTAGGAAGACTTGACCCACCCCAGCGATTCTATCTGTCGGTCCGGCAATTACGCGGGCCGGACTCTAGAGCTGAGTATCTACCGAAACCTCACCGCCCAAATTTCCCGCGACCTCCCCAGCGACCGGTTGGGATGGACCCGAAATCCGGCACCCTCAGCGCGGAAGAGTGCCGAAGGGAAGCAACCTGGGGCCAAGGCGGGGAAGCCAGCCAGCTCGTCTAGGCGGAGAGGCGAGCAGCTTAGCCGGATGAAACCGCAGCTCGGGTAAAGAGAGGCGAAGGCGAACCCGACGGAGAGGAAGCCGCCAGGCAGGTCGATAAGGAGAGGGGCGCCTACGCGTCGATAAGCAAGATCGAGAGCCAAGGAGTACCCCGCAAGCGAGGAGAACAGGGGGCCTGCAAGCCGGTCGATAAGAGGAGCCAGCTCGCGCTAGGTCGTTGCGGGAAGGGCTCCCGCCCTTAATCGCGGTTGGAGCACCCGGCTAACCCCGGAGCTTTACGGCGGCGGAGGCCGGTTCCCGACTGGACTGTGGTGGCCGAGCCGCCACCTCCCGCCCGCCACCGCTCCCGGAAGCCCAGGGAAGGCCCGGCGCACCCCAAGCGAGCGCCGGGAAGGCCGCGCGAAACCGAAGGAAGCCCAACCGCCGGTCTCCCGCCCCAATCCGCCATCGCTGGGAAGAGCCTCCCCTCGCCGCGACCGCCAGGCGGATGCCCAAGGGGAGGTGAACGCAAGGGCCCACCGGCCCCGGGGAGCAACCGTATCCGAAAGTCGTGCCGAAGGAACGGGCCGCGGGCCGGGTGGAAGGTGGGCCCCGGCCTCCGACCCCCGGCTGCGACCGGAAGCCAGAAGGCCCAGCGCCGCACGGACCCGGCGCCGAAGACCCCACTCCGAGGCGGAAGGGAGCGACGCCCGCCGGGGCCCGGGCCAAGGGAAAGAGAGCCCAGGCACCGGCTCGACCCAAGCAGCCCGCGGACCCGGAAGCAAGGCGCCGCCAGGGAGCAACCCGCCGGCCAGGCCAGCAGCCGGCGCCCTAGACGCCAAGCGGGGCCAGCCAAGCCGCCCGCGCCAGCCCCCACAGGAAGGGGAGGACGCCCAAGGGCCAAGGAAGGAAGGGGGCGAAGCACACCGAACAGCCAGGCCCGGACCGGAAAACGAGCACCGCGGCCGGCACAGCCGGGCCGGCGGGGCAGAGGGCCCAAGCCAAGAAGCCCCCCGCCAAGGCGGAAGCGGAGGGCGACCGCCCACCCCGACCGCCGCGCCCGACGCCGACAGGAGGGCACCCGGTATCCCGGCGCCGCCCACCGCCCCGGGACCGCGAGGGGAGCAGCCCCGCCCAAGGAGCGGAAGTGCCAGCACCGGAGACCGCCACGGAAAACCGGGATCCGAAGCCCCAGCCCGCCCAAGCCACCGCCCAAGCCGCCCGCGGCGGCCCACGCGACAACCCGCACCGGCCGGCGCAGGCCCACCGACCCGGCCACGCCGCCCCCCGCCGACGCGGCGGCGGACCCCGCCGCCCGAAGGGCGCGCCCCCCAGCGAAGGAAGCGCCCCCGGGGGCCGGCAGGCGCAGCCGCCCGCAAGACAAGCCGCCCGCGGCGCCGGCGGCCGGAACCCTGGGCGGCCGGGGCCCAGGGCCCGGGGAGCGGGAGCCCGGCCGGCACCGAACCGCGCGCGGGGGGCAGGGCAGCCGCCACAACCGGCCGGCACCGGCCGAAGAAGGGGGAACGAAGGGCCAGGACACCGGCCAACGCCGCCCCACAAGGACCCACAGCCGCGCCGGCCGCGACCCGAAAGGGCCCGAGCACCGCCGCGGCGCAGGAAACAGCCCGCCCGCGAAGCCCCGCGACCCAAAGCCGCCCAGGGCACCCTGGGCCCAACCCCGAAGGGCCAACCGCGGCCGCACCCCCACCGCCCGCGACCCCAGCCGCCAAGCCAAGCCCAGGCCGCGAGACCAGCCCCAGCGAGCGCCCGCCGGCCACCCAAGAGCCCGGACCGCCGCCCGGCCGGGCCGCAAGCGCCCAGCCACGCGAGCGCAGCACGGCCGCCGCGAGGCGGCGCCCCCGCCCGGCGCCGAGGCCGGCGGGAGGCCCGGCCGCCGAGGAGCGCCGCCGCCGGCCAGGCGGCCGGGGGCGCCACGCCGCCGCCGCAAAGGCGCGCCCGCCGCGGAACGGCCGGCAGCGCGAAGCCGCCAGGCCCCGCCGGCGGCCGGGCCCGCGCCGGGGGCGGCGGCAGCGCGCCCGCCCCCAGCGGCCCGCCCCGCCGCGCGCCGAACACAGCCAGCAGGGCAACACGCGGCGAGCAGCACGCGGCGCAAGCGGCGCGCCGCCGGAACCGGCCCGCCGAAGCAAGCGGCGAACGCGACCCCAAAACGCCAAAAGCGGCGGACAGCGCCGCACCCGCCGGGCCCGAACCCAGCCCAGGCCCCAGGCAGCGGCCAGCCCCCGCCCGCGGCCAAGCCGGCCCCGGAAACCCAGCGACCCCCCCGAGCAGCAGCGGGCCAGACCCGGCCGCCCCGCGACCGCAAAACGGGCGCCCAACGGCAGCCAGCCCCGGCGACAGCCGGCCCCGGAACAGCCGCCCCACACAGCAGCACCAGCGCGCGCCCGGCCCGCAAAACCGCGGACCCCGCCCCAGCGGCCCCACGCGCAGCAGGGACGGGAGAGCGGGCCCAAGCACGGCGACCCGCCCAAGCGCGGGACAGCGCGCCCCCAAGCAACCCCCCACGCGCGGAAACCGAGCGCACGGCCGCCGGCCAGCCCGGCCCACGGCCGCCCGGGCCAAAACCGCACAGCGAGCCCAGCGCCGCCACCCGCCGCGCAGCCAGGAGCACGGCCGCCGCCACAGCCACCGCAGCGGCCAGGGCCGCGGCAAACCGACCGCCCAAGAGCGGGACCCGACCAACGCGGCCGAAACGCGCCGCCGCCAGCGCCCGCCCACAGGGCGGCGCAAAACCAGGCGCAACAACCGGGGCAAGACGGCCCGGCGCCGCCCGGCCGCACGGGAGCAAAGCCGGCCGGGCGACCACCGCAGGGCCCCGAGCAACCGCGGACGCCAGCCGAGCACGCCGCGGAGCGAGACCCCCGCCCGGCGGCCGGCAAAGCGACGCCAACGCCGGCGGGCGGCGGCCGCGCCCGCGCGCCGGCGCCGCCAGCCGCGCAACGCCACCCCGGCCGCGGCAAAGACGCGGAAGGCCAACGGGGCGGCCACGCGCCCCCGCGAGAGCGCGGGGCGCCGCCGCGCCCCACACGCCGCGCCGCGCAGCCCGAGCCACGCCCCCCCAGCGCAAGAAAGACGCGCCCCAGGCGCCGCGCCGCCAGCGGCGGAAGCCACCCCCGAACAGCAGCAAAGCCGCCGGGAAACCGCGCCGAAGCCCACCGAGCCCCACGACAAGCGCCGCCGCCGCGACCGCAGCGAACGCCCCGCGGGGAGCCGAACCCCGGCCGGCCGCGCAAACGGCCCAAGCGCCAGGCCGCAGCAGCAGCGCGCCGCAGCCAGCACCCGCCCCGCCCCGACAGCGCGACCGCACGCCCCGCGCGACCAGCGCCAACAGCCCCGCAGGGCCGGCAGCCCCCCAGCAAGCGCCGCGCCGCCCCACGGCCCAACAACCCCAAAGCCAAGGAGGCGGGCGCAGCCGCCGGCCGAACACCCGCAGCGGGACCGAACCGCACGCGCCGCGCAAGCCCGGCCAAGGGAGCGAGCCACACGCCCCACCCCCACCCGGGCCGGCGGCCAACCCAAGGCAGCGAACACCAGCCGCGGGCGGGCCCGACGCGAGCAAAGCCAGCACAAAGCAGCAACCACGCGCAAGCGGGCCGCCAGAGCCCGCACCACCGGCGCCGCAGCGCAGCAACCCGAGCCAGCAAGGACCCCGCAACCAGCGCGGACCCGCCAGCCCAGAGCGGCCCCACGACCACCGGCGACCCCAACGCCAACCGCGCCGCAACCACCCCGCCGACGCGAAGCACGACGCGCAGCCCCAGGGACCGCCGCACGGCAGCGCCGGCCACGGCCACAACAAAAGCGGCAACCGGCCGACCCGCCGGCCCCCCGCGAAAACCCCCGCCCCGCCGCGAAGGAGGCGCAAAGCGCAGCCAGGACGGCGCAACGCCCCGCCACAACGCCCAGCCACGCCGCGCGAGCCGAACCAGCAAAGCGCGCCAAGCGCAGCCCAAGAGGACCGAACGGCCCGGCCGGAAGCGAGCAGCCACCACCAGCCCCGCCGCCCCCCACCGCGCCGAACCCCAGCAACCAGCGCGGACAGCAAAGCGCGCGCACCGGCCGAGCCGCAGCCCCCCGACGGGAAGCCCCGAACCCGACCAAACACCCGCGGCCGCCAAACCGCCCACCGCCGCCAAAGGCGCGAAGCCAACCGCCGCCGCGCCAAGCCCCCACGCCGGCCCACCAGCCCGCGCAGCCGCGCCGACAACGCCGCGCCCCGCGGCCGCAAAAGCCAACGCAAAGCCGCACGGCAAGAGACCCCCGCCGCGCCGCCAGCGGCGACAACAGCCCGCACGGAAGCCGAGGCGAAACGCCCAGGCCGCGCCGCGCCGCGGCCCGCCGCCGCAGCCCACCCGCCGCCCCCGCACGCCCGCCCCGCCAAAGCGCCGCCGCAAGCGGGCACCCGCCCCGCCCCCGCGGGCGACCCGCCCGCCGCCCCCCCGCGAGCAAAGCCGCCAGCCGAGCAAACAGCCGACCGGCAGCGCGCCGGCGCGGCACCCAGCCGCCCGCCCAGCCGCCGCAAGCGCCCCGCACGCCGCCAAAGAGAGCAACGGCCGCCCCCCAACGGCCGCGCCGCCCACCAGCCAAGAGCCAGGCGACCCGAACCCAGCAACCGCGGCAGCACAACAAGCCGCCGCGCACACCGCAGCCGACCCGCGCGAGCAAAGGACCCGCGCCAGCCAGCCCGGCAGAGCGCGGGCCCGCAGCCCAGCCGGCCCCCCACAACGAGCCGGACCGCCCCGCCGCCAGCCCAAGGAGCCCAGCAAGGCAGCACAGACAGAGCACGCCAGCCAGCGCCCACGCGAGCAGCAACACCACCCGAAAGAGCCGCCACAGCGACACGCGCAGCCGCGCCCGCAGCCCACCAGCGGCAGGCAGCCGGACCCCGCACGCAGCAAAAGCAGCGCGGCCCCGAACGACCCGAACGCGGCAAGGCCGACCCACCACCAGCAGCAGCAGCAGCCCGCCGCGCAGCACGGGGACACCGCACACACGCCAAGCCGCCGCCCCACAGCCGCCCAGCACGGCGCCGCCGCGCAGCAACGCCGCCAAGCCCGCAGCCGACCGCGCAGCAGCAAGCCAGCCCGGCCACGGCAAGCCGAAGCCAGCAGCAGCCAACCCACCAGCCCAACGAGCGCGCCGCCCACGCCCCAGCGCCGGCCAGCGCGCACCGGCCGACCGCACGCCCCCGCGCGCGAACAGCACACCAGCCGCCCCCCCAAGCGCGGCCAAGCAAGCGCAGCACGCACGGCCAAAAGCAGCCGCAGCCGAGCAACCCCACCACCCGCAAAGCAGCACGAGCAGCCAGCAACGCAGCAGCAACAAGCACAGCAGCCCCCGCGGAACAACCGCGCACCGCCGCCCCCCGAACCAACGAGCCGCCAGCAGCGGCAAGCCACGGAGCACCAAAGCGCCAGCAGAAAAGAGCAGCCGAGCAACAGCCCCCGCCCCGGCCCCAACCAACAGCAACCGCGCAAAGCACCCCACCGCCCGCCCGCCCCCGCCGAAAGGACCGCCACCCGCCACCACCGCGCACGCCCCCGCCGCAACCACGCGCGCCAGCGCACGCCAGAGCACCCGCCGCCAAGGAGCACAACCGGCAGCCAACCAGCACCCCGCCCGCCCCGCAAAGCACCGCACACCGCCACAAGCCCGCCCAAAGCCAGCCAAGCGACCCCCGCGAGCGCCCGCCGCGCGCACCCGCCGCAACACAGCGCGCGCAACAGAAGCAGCCCGAGCCGCCCAGCCAGCAGCACGCACCAAGCAGCCCAGCAGCAAGCGACGCGCCCAGCCGCGCCCAGCCCAAAGCCAGCAAGCCGCCCCGAGCGCGCCGGCCGAACCGACAAGAACAGACAAAGCACAGCAAACCACAGGCAACAACAGCAGCAGCCACCCAACCCCGAGCAGCAGCACGCAAGCAGCACACCCGCCCCCAGCCAACGAGCAGCACAACAGCACCCAGCAAGCACCCACCACCGCCGCCGCCGCCGCCGCCCCGCAGCCGCCCGCGCCCCGCCGCCACCGCCACCGCCACCGCCACCGCCACCGCCACCGCCACCGCAACAGCAACAAGCAGCAACAGCAAGCAGCAACAGCAAGCAACAACAGCAACAAGCAACAACAAGCAACAACAACAAGCAAC |

Due to the very lengthy nature of the sequences in this figure, which are difficult to fully render without error, only the identifying information and partial sequence data are presented in this transcription.

FIG. 16AAAAP

| | | SEQ ID NO: | |
|---|---|---|---|
| Ruminococcus_brom ii_ATCC_27255_NC BI_L76600 | Ruminococcus_br omii | L76600 | SEQ ID NO: 299 | TTTGATTTAGTTTAGTTGGCGGACGGGTGAGTAGTAACGCGTAACCTGCCTTCAAGAGGGGGATAACATTCTGAAAAGA ATGCTAATACCGCATGACATATCGGAGTTCGCATGAACTCGGATTATGCTTGAAGATGGACTCGCGTCCG ATTAGTTAGTTGGTGAGGTAACGGCTCACCAAGACCGTGGATGATCAGCCACAGAGGTGAGAGTGAACCCGGCCACATTGGG ACTGAGACACGGCCCAGACTCCTACGGGAGGCAGCAGTGGGGAATATTGCACAATGGGCGCAAGCCTGATGCAGCGACGCCGCGT GCGGGATGAAGGATGAAGGTTTCGGATTGTAAACTCTTTAATCGGGGACGAAAATGACGGTACTTAATGAATAAGC TCCGGCTAACTACGTGCCAGCAGCCGCGGTAATACGTAGGGGGCAAGCGTTGTCCGGATTTACTGGGTGTAAAGGGTG CGTAGGCGGCTAGAGGCGGAAATTCCCGCGTGTCAGCGGTGAAATNCTATGGGCTCAACCCATAAACTGCATTTGAAAACTGTATTGAGCTGAAGTGAGGTG AAGTAGAGGCAGGCGGAATTCCCGGTGTAGCGGTGAAATGCGTAGAGATCGGAAGGAACACCAGTGGCGAAGGCGGCC TGCTGGGCTTTAACTGACGCTGAGGCTCGAAAGCGTGGGGAGCAAACAGGATTAGATACCCTGGTAGTCCACGCCGTA ACGATGATTACTAGGTGTGAAACTCAAAGGAATTGACGGGGGGCCCGCACAAGCAGGATGGGCCTAGTCGGAATCCCTATTAGGT TATTCCTTACCAGGTCTGACATCCAACTGATCCACCTTAAGCCGCTCTGCCCTTCGGGGAAAAAGTTGAACACAG GTGGTGCATGGTTGTCGTCAGCTCGTGTCGTGAGATGTTGGKTTAAGTCCCGCAACGAGCGCAACCCTTGCTATTAGTT GCCAGCGATTAAGTCGGGGAACTCTAATGAGACTGCCGGTTACAAACCGGAGGAAGGTGAGGATGACGCCAAGTCATCATGCCCC TTATGACCTGGGCTACACACGTGCTACAATGGATGGTATAATGGGCAGCGAAACTCGTGAGGTGGAGCAACCCGGAGCAAATCATCAAAACCATCCC CGGTCAGCGAACCGGAATGCCGAAGGCGGAATCGCTAGTAATCGCGGATCAGCATGCCGCGGTGAATACGTTCCCGGGCCTT GTACACACCGCCCGTCACACCATGAGAGCCGGGGGGACCCGAAGTCAGTAGTCCAACCCTAATGAGGCGCAGCGCCGAAG GCTC |
| Ruminococcus_brom ii_L2_63_NCBI_EU2 66549 | Ruminococcus_br omii | EU266549 | SEQ ID NO: 300 | GACGAACGCTGGCGGCGTGCCTAACACATGCAAGTCGAACGGAACTGTTTTGAAAGATTTCTTCGGAATGAATGATCTAAT AGTTAGTGCAGTAACCGATGGGTAGGGGATAACCTGAGTAGTAACCTGCCTTCAAGAGGGGGATAACATTCTGAAAAGAATGCTAAT ACCGCATGAYATATCGGAGTTCGCATGAACTCGGATTATGCTCGCGTCCGATTAGTTA GTTGGTGGAGTAACGGCTCACCAAGACCGATATCGGATAGCTGGTCTGAGAGGATGAACAGCCACATTGGGACTGAGAC ACGGCCCAGACTCCTACGGGAGGCAGCAGTGGGGAATATTGCACAATGGGCGAAAGCCTGATGCAGCAACGCCGCGT GAAGGATGAAGGTTTTCGGATTGTAAACTTCTTTAATCAGGGACGAAACTTAATGACGGTACTTGACGAATAAGC CTACGGCTAACTACGTGCCAGCAGCCGCGGTAATACGTAGGGGGCAAGCGTTGTCCGGATTTACTGGGTGTAAAGGGTGCGTAGGCGG CTTTGCAAGTCAGATGTGAAATCTATGGGCTCAACCCATAAACTGCATTTGAAAACTGTAGAGCTTGAGTGTAAGAGAGGCAAGCGG AATTCCCGTGTAGCGGTGAAATGCGTAGAGATGTGGAAGAACACCAGTGGCGAAGGCGGCCTTCTGGCT TAACTGACGCTGAGGCTCGAAAGCGTGGGGAGCAAACAGGATTAGATACCCTGGTAGTCCACGCCGTAAACGATGATT ACTAGGTGTGAAACTCAAAGGAATTGACGGGGGCCCGCACAAGCGGTGGAGCATGTGGTTTAATTCGAAGCAACGCGAAGAACCTT ACCAGGTCTTGACATCCAACTGACCAGCCTAGAGATAGGTCTCTCTTCGGAGCAGTTGGTGACAGGTGGTGCATG GTTGTCGTCAGCTCGTGTCGTGAGATGTTGGGTTAAGTCCCGCAACGAGCGCAACCCTTATGCCATG AGCACTCTAATAGGACTGCCGGTTACAAACCGGAGGAAGGTGGGGACGACGTCAAATCATCATGCCCCTTATGACCTGG GCTACACACGTACTACAATGGATGATAATGGAAGCAAAACTGCGAGAGTAAGCTAATCTCTAAAAACATTCTCAG TTCAGATTGCAGGCTGCAACCGCCTGCACATGAATACGGTGAAGGCTAGTAATCGCGAGTCAGAATGCTGCGGTGAATACG TTCCCGGGCCTTGTACACACCGCCCGTCACACCATGGGAGTCAGCAACGCCGAAGTCAGGACTAGCCAACCTGTAATACG ACGTGCCGAAGGTAGGATTGGCGACTGGGGTG |
| Ruminococcus_hans enii_NCBI_M59114 | Ruminococcus_ha nsenii | M59114 | SEQ ID NO: 301 | GAGAGTTTGATCCTGGCTCAGGATNAACGCTGGCGGCGTGCCTAACACATGCAAGTCGAGCGAAGCACTTATCATTGAC TCTTCCGAAGATTTGATATTTGACTNAGCGCGGACGGGTGAGTAACGCGTGAGTAACCTGCCTCATACGGGGAATAA CAGTTAGAAATGACTGCTAATACGCATNAGCGCACAGGATGAACGCATGGTCTGTGCTTGTGAAAACTCCGGTGGTATGAGAT GGACCCNCGTCTCGATTAGCTAGTTGGTGGGGTAACGGCCTACCAAGGCGACGATCAGTAGCCGACCTGAGAGGGTGAA CGGCCACATTGGGACTGAGACACGGCCCNGACTCCTACGGGAGGCAGCAGTGGGGAATATTGCACAATGGGCGAAAGC CTGATGCACATTGGGCCCGTGAAGGATGAAGGCCNGANGCCGTGAGGAAGATACGGTATCTAGGCAGCCAGAAGAAATGACGGTAC CTGACTAAGAAGCCCCGGCTAACTACGTGCCAGCAGCCGCGGTAATACGTAGGGGNCAAGCGTTATCCGGAATTACTG GGTGTAAAGGGAGCGTAGACGGAGAGCAAGTCTGATGTGAAAGGCTGGGGCNCAACCCCAGTATTAGGATATTACTG GTTTTTCTAGAGTGGGCGNNGAGGACGTAAGCGGAATTCCTAGTGTAGCGGTGAAATGCGTAGATATTAGGAGGAACACCAGT GGCGAAGGCGGCTTACTGGACGATCACTGACGCTGAGGCTCGAAAGCCAGTGGCGAAAGCGTGGGGAGCAAACAGGATTAGATACCCTG GTAGTCCACGCCGTAAACGATGAATACTAGGTGTCGGGGCTAAAACNGCTCAGGTGCCGCAGCAACGCAATAAGTATTCC |

FIG. 16AAAAQ

| | | | |
|---|---|---|---|
| Ruminococcus_lacta ris_ATCC_29176_N CBI_ABOU02000004 9 | Ruminococcus_lac taris | ABOU02000004 9 | SEQ ID NO: 302 | ACCTGGGAGTACGTTCGCAAGGAATTGACGGAATTCAAAGGAATTGAAACTCAAAGGAATTGACATGGTTTA ATTCGAAGNNAACGCGAAGAACCTTACCAAGTCTTGACATCCTGCTGACGGTCTTGGAGAGTCTTCGGGACAG GCAAGACAGGTGGTGCATGGTTGTCGTCAGCTCGTGTCGTGAGATGTTGGGTTAAGTCCCGCAACGAGCGCAA ATCCTTAGTAGCCAGNAGTCCGGCTGGNNACTCTAGGGAGACTGCCAATGGCTCAGGGAGACTGCCGACGTC TNNAATCATCATGCCCNNNATGATTGGGCTACAACGTGCTACACACGTGCTACAATGGCGTAATACAAAGGGAAGCGAAGCGGTGACGC TTAGCAAATCTCAAAATAACGTCCAGTTCGGACTGCAGTCGACGGACTGCAGTCTGCAACTGCAGAAGCTGGAATCGCTAGTAATC GCGAATCAGATCTCGCGGTGAATACGTTCCCNGGTCTTGTACACACCGCCCGTCACACACCGAGAGTCAGTAACGCGACGCCCC GAAGTCAGTGNCCAACCTTATGGAGGAGCTG
(sequence content) |
| Ruminococcus_obeu m_A2_162_NCBI_F P929054 | Ruminococcus_ob eum | FP929054 | SEQ ID NO: 303 | (sequence content) |
| Ruminococcus_obeu m_ATCC_29174_NC BI_X85101 | Ruminococcus_ob eum | X85101 | SEQ ID NO: 304 | (sequence content) |

FIG. 16AAAAR

| | | | |
|---|---|---|---|
| Ruminococcus_sp_5_1_39BFAA_NCBI_ACii01000172 | Ruminococcus_obeum_NCBI_AY169419 | Ruminococcus_obeum | AY169419 | SEQ ID NO: 305 | AGTATCCGGTATGTAAACTTCTATCAGCAGGAAGATAGTGACGGTACCTGACTAAGAAGCCCCGGCTAACTACGTGC CAGCAGCCGCGGTAATACGTAGGGGGCTAGCGTTATCCGGATTTACTGGGCGTAAAGGGAGCGTAGACGGACTGCAA GTCTGATGTGAAAGGCTGGGGCTCAACCCCTGTAGAAACTGTTAGTCTTGAGTGCCGGAGAGGTAAGCGGA AATTCCTAGTGTAGCGGTGAAATGCGTAGATATTAGGAGGAACACCAGTGGCGAAGGCGGCTTACTGGACGATTACTAGGTG CGTTGAGGCTCGAAAGCGTGGGTAGCGAACAGGATTAGATACCCTGGTAGTCCACGCCGTAAACGATGATTACTAGGTG TTGGGGAGCAAAGCTCTTCGGTGCCGCAGCAAGCCATTAAGTAATCCACCTGGGGAGTACGTTCGCAAGAATGAAACT CAAAGGAATTGACGGGACCCCGCACAAGCGGTGGAGCATGTGGTTTAATTCGAAGCAACGCGAAGAACCTTACCAAGT CTTGACATCCCTCTGAACCCTCTAGAGATAGAGCTTTCCCTTCGGGGACAGAGAACAGGTGGTGCATGGTTGTCGTCAG CTCGTGTCGTGAGATGTTGGGTTAAGTCCCGCAACGAGCGCAACCCTTATGATTAGTTGCCAGCAGGT CACACGTGCTACAATGGCGTAAACAAAGGGAAGCAAGCCTGCGAAGGCAAGCGAATCTCATAAAATAACGTCCAGTTCG GACTGCAGTCTGCAACTCGACTGCACGAAGCTGGAATCGCTAGTAATCGCGAATCAGAATGTCGCGGTGAATACGTTCC CGGGTCTTGTACACACCGCCCGTCACACCATGGGAGTCAGTAACGCCCGAAGTCAGTGACCTAACCGTAAGGAGGGAGC TGCCGAAGGCGGGACCGATGACTGGGGTGAAGTCGTAACAAGGT |
| | | | SEQ ID NO: 306 | AGAGTTTGATCCTGGCTCAGAATGAACGCTGGCGGCGTGCCTAACACATGCAAGTCGAACGGGAATTACTTTATTGAC TTCGGTCGATTTAATTATTCTAGTGGCGGACGGGTGAGTAACGCGTGGGTAACCTGCCTTATACAGGGGATAACCAGTC AGAAATGGCTGCTAATACCGCATAAGCGCATAGCTCAGTGCTGAAAAACTCCGGTGGTATAAGATGGACC CGCGTTGGATTAGCTAGTTGGTGGGGTAACGGCCCACCAAGGCGACGATCCATAGCCGGCCTGAGAGGGTGAACGGC CACATTGGGACTGAGACACGGCCCAGACTCCTACGGGAGGCAGCAGTGGGGAATATTGCACAATGGGCGAAAGCCTGA TGCAGCGACGCCGCGTGAGTGAAGAAGTACGTCGGTAATCGTAGCGGATCGAGGGATCTACTGGGCGTTACTGGGTGT TAAGAAGCCCCGGCTCAACTACGTGATGGTGTGAAATGTGAACGGCTCAAGTACGAGTGGTCGAAACTGTCATA CTTGAGTGCCGGAGGGGTCAAGCGGAATTCCTAGTGTAGCGGTGAAATGCGTAGATATTAGGAGGAACACCAGTGGCGA AGGCGGCTTACTGGACGGTAACGACGTTGAGGCGCGAAAGCGTGGGTAGCAACAGGATTAGATACCCTGGTAGTCC ACGCCGTAAACGATGAATACTAGGTGTCGGGTGGCAAAGGCCATTCGGCCCACAGAGTAACGCGATAAGTATTCCACCTG GGAAGTACGCCAGCAAGGTGGAAACTCAAAGGAATTGACGGGGACCCGCACAAGCGGTGGAGCATGTGGTTTAATTCG AAGCAACGCGAAGAACCTTACCTGGTCTTGACATCCCACTGACCGGTCTAGAGATAGACCTTTCCTTCGGGACAGTGGA GACAGGTGGTGCATGGTTGTCGTCAGCTCGTGTCGTGAGATGTTGGGTTAAGTCCCGCAACGAGCGCAACCCTATC CTCAGTAGCCAGCATTAAGTTGGGCACTCTGGGGAGACTGCCAGGGATAACCTGGAGGAAGGCGGGGATGACGTCAA |

FIG. 16AAAAS

| | | | |
|---|---|---|---|
| Ruminococcus_sp_K_1_NCBI_AB222208 | Ruminococcus_sp_K_1 | AB222208 | SEQ ID NO: 307 | ATCATCATGCCCCTTATGATTTGGGCTACAACACGTGCTACTAGTCTGCAAACGTGGTAAACAAGGAAGCGAGAATTGTGAGATGGAG CAAATCCCAAAAATAACGCTACAGTTCCAGATCGTTCCGGGGATTGCAACGACTAGACAAGCTGGAATGCTGGAGTAACGCCGA GATCAGAATGCGCGGACTTGGATTAGCGTTGGTGGTGAATACGTTCCCGGGCCTTGTACACACCGCCCGTCACACCATGGGAGTGGG CCCACATTGGGACTGACCTAACTGCAAAGAAGGAGCTGCCGAAGGCGGACTGGATCACCTCCTTCT TATCCGAAGGTGCGGCTGGATCACCTCCTTCT |
| | | | SEQ ID NO: 307 (continued) | CCTGGCTCAGGATGAACGCTGGCGGCGTGCTTAACACATGCAAGTCGAACGAGTGTGGCGGACGGGTGAGTAACGCGTG GGTAACCTGCCTTATACAGGGGATAACAGTCAGAAATTGCTGCTAATACCGCATAAGAAAAGTGGTATAAGATGGAC CGCGTTGGATTAGCTAGTTGGTGGTGGTAACGGCTACCACAAGGCGACGATCCATAGCCGGCCTGAGAGGGTAACGG CCACATTGGGACTGAGACACGGCCCAGACTCCTACGGGAGGCAGCAGTGAGGAATATTGCACAATGGGCGAAAGCCTG ATGCAGCGACGCCGCGTGAAGGAAGAAGTATCTCGGTATGTAAACTTCTATCAGCAGGGAAGATAGCGACGGTACCTGACTA AGAAGCCCCGGCTAACTACGTGCCAGCAGCCGCGGTAATACGTAGGGGGCAAGCGTTATCCGGATTTACTGGGTGTAA AGGGTGCGTAGACGGGAAGACAGGACAAGCGTTGAAATGTTGGGGCTCAACCCCATAACGCAGTGGAAAC TGAGTGCCAGCAAGGTAAGCGGAATTCCTAGTGTAGCGGTGAAATGCGTAGATATTAGGAGGAACACCAGTGGCGAAGG CGGCTTACTGGACTGTAACTGACGCTGAGGCACGAAAGCGTGGGGAGCAAACAGGATTAGATACCCTGGT CGTAAACGATGAATACTAAAGGTGGGGACACTGAATGTGTCGGTGCCGCAGCAACGCATTAATGCTTCCGCCTGGGGAGTACGTTCG CAAGAATGAAACTCAAAGGAATTGACGGGGACCCGCACAAGCGGTGGAGCATGTGGTTTAATTCGAAGCAACCGAAG AACCTTACCAAGTCTTGACATCTGACAGGTGCGCCAGAAATGGCACACTCTCAGGAAGGTCAACACAAGGTGACACAGGTGGTGCATGGTTGTCGTCAGCTCGTGTCGTGAGATGTTGGGTTAAGTCCCG CAACGAGCGCAACCCCTATCCTCAGTAGCCAGCATTAAGTTGGGCACTCTGAGGAGACTGCCAGGGATAACCTGGAGGAAGG CGGGGATGACGTCAAATCATCATGCCCCTTATGATTTGGGCTACACACGTGCTACAATGGCGTAAACAAAGAGAAGCAAGACCGCGAGGTGGAGCAAACTCAGAAAATAACGTCTCAGTTCGGATTGTAGTCTGCAACTCGACTACATGAAGCTGGAATCGCTAGTAACGC GGAGCAATGCGCGGACTTGGATTAGCTAGTTGGTGGGGTAACGGCCTACCAAGGCGACGATCCATAGCCGGCCTGAGAGGGT AACCCTTACCACCTGCATCGAGGACAGGGTCGGCGTACACACCGCCCGTCACACCATGGGAGTGGGGTTACACAGAAGTCGGTAGTCTAACCGCAAGGAGGGCGCTTGCCACGGTGGGATCAGCGACTGGGGTGAAGTCGTAACAAGG TATCCGGCGCGG |
| Ruminococcus_torques_ATCC_27756_NCBI_AAVP02000002 | Ruminococcus_torques | AAVP02000002 | SEQ ID NO: 308 | GAGAGTTTGATCCTGGCTCAGGATGAACGCTGGCGGCGTGCCTAACACATGCAAGTCGAACGAAGCACTTTGCTTAGAT TCTTCGGATGAAGAGCTGGTGACTGAAGAGATTGTGACTGAGTGGCGAACTCGTGGGTAACCTGCCTCATACAGGGGGATA ACAGTTAGAAATGACTGCTAATACCGCATAAGACCACAGGGTGACATCCATGTCCTGTGGGGGGTAAAACTCCGGTATGAAGA TGGACCCGCGTCTGATTAGCTAGTTGGTAAGGTAACGGCTTACCAAGGCGATGATCAGTAGCCGACCTGAGAGGGTGAACGG CCACATTGGGACTGAGACACGGCCCAGACTCCTACGGGAGGCAGCAGTGGGGAATATTGCACAATGGGGGAAACCCTGATG CAGCGACGCCGCGTGAGCGATGAAGGTCTTCGGATCGTAAAGCTCTGTCTTGAAGGGAAATAACGACGGTAC CTGACTAAGAAGCCCCGGCTAACTACGTGCCAGCAGCCGCGGTAATACGTATGGGGGCAAGCGTTATCCGGATTCACTGG GTGTAAAGGGAGCGTAGACGGAATGGCAAGTCTGATGTGAAAGGCTCCAGCTCCAACTGGGGAACTGCATTGGAAACTG TTCATCTAGAGTGCTGGAGAGGTGAGTGGAATTCCTAGTGTAGCGGTGAAATGCGTAGATATTAGGAGGAACACCAGTGGCG AAGGCGGCTCACTGGACAGTAACTGACGCTGAGGCTCGAAAGCGTGGGGAGCAAACAGGATTAGATACCCTGGTA GTCCACGCCGTAAACGATGAATACTAGGTGTCGGGTGGCAAAGCCATTCGGTGCCGCAGCAACGCAATAAGTATTCC ACCTGGGGAGTACGTTCGCAAGAATGAAACTCAAAGGAATTGACGGGGACCCGCACAAGCGGTGGAGCATGTGGT TTAATTCGAAGCAACGCGAAGAACCTTACCAGGTCTTGACATCCCGCTGACCGCAGCAGCGGCAAATGGAGCACTTTCTTCGGAGCGGGCAAACAGGTGGTGGCATGGTTGTCGTCAGCTCGTGTCGTGAGATGTTGGGTTAAGTCCC GCAACGAGCGCAACCCCTATCGCAGCAGTGGCAGGGACTTGCTGAGGAAGACGCCGGTGACAAACCGGAGGAAGG TGGGGATGACGTCAAATCATCATGCCCCTTATGATTTGGGCTACACACGTGCTACAATGGCGTAAACAAAGGGAGGCGAAGCCGTGAGGTGGAGCCAAT CCCAAAAGTAACCTCAGTTCAGATTGCAGTCTGCAACTCGACTGCATGAAGTCGGAATCGCTAGTAATCGCGG ATCAGCATGCCGCGGTGAATACGTTCCCGGGCCTTGTACACACCGCCCGTCACACCATGGGAGTCGGTAACACC CGAAGTCAGTAGTCTAACCGCAAGG |
| Ruminococcus_torques_L2_14_NCBI_FP929055 | Ruminococcus_torques | FP929055 | SEQ ID NO: 309 | GAGAGTTTGATCCTGGCTCAGGATGAACGCTGGCGGCGTGCCTAACACATGCAAGTCGAACGAAGCACCTTGATTGAT TCTTCGGATGAAGATCTGGTGACTGAGTGGCGAACTCGTGGGTAACCTGCCTCATACAGGGGATA ACAGTTAGAAATGACTGCTAATACCGCATAAGACCACAGGGTGCGCATGCACACCACCACCATGTGAAAACTCCGGTGGTATGAAGA TGGACCCGCGTCTGATTAGCTAGTTAGTGGTGGGGTAACGGCCTACCAAGGCGATGATCAGTAGGGGTTCTGAGAGGGTGA CCGGCCACACATTGGGACTGAGACACGGCCCAGACTCCTACGGGAGGCAGCAGTGGGGAATATTGCACAATGGGGGAAAC CCTGATGATCAGCGACGCCGCGTGAGCGATGAAGGTCTTCGGATCGTAAAGCTCTATCAGCAGCGAAGAAATGACGGTAC |

FIG. 16AAAAT

| | | | |
|---|---|---|---|
| Sporobacter_termitidis_SYR_NR_044972 | Sporobacter_termitidis | NR_044972 | SEQ ID NO: 310 | CTGACTAAGAAGCACCGGCTAAATACGTGCCAGCAGCCGCGGTAATACGTAGGGTGCAAGCGTTATCCGGAATTACTGG GTGTAAAGGGAGCGTAGACGGAGTGGCAAGTCTGATGTGAAAACCCGGGGCTCAACCCCGGGGACTGCATTGGAAACTG TCAATCTGGAGTACCGGAGAGGGAAGCGGAATTCCTAGTGTAGCGGTGAAATGCGTAGATATTAGGAGGAACACCAGTG GCGAAGGCGGCTTACTGGACGGTAACTGACGTTGAGGGCTCGAAAGCGTGGGGAGCAAACAGGATTAGATACCCTGGTA GTCCACGCCGTAAACGATGCATACTAGGTGTCGGGGAGCATTGCTCTTCGGTGCCGCAGCAAACGCAATAAGTAGTCC ACCTGGGGAGTACGTTCGCAAGAATGAAACTCAAAGGAATTGACGGGACCCGCACAAGCGGTGGAGCATGTGGTTTA ATTCGAAGCAACGCGAAGAACCTTACCTGCTCTTGACATCTCCTGACAATCCTAGAGATAACGAGGGGTTGCTTCCTCGGAACAG GGATGACAGGTGGTGCATGGTTGTCGTCAGCTCGTGTCGTGAGATGTTGGGTTAAGTCCCGCAACGAGCGCAACCCCT ATCTTTAGTAGCCAGCGGTCAGGCTGGGCACTCTAGAGAGACTGCCAGGGATAAACCTGGAGGAAGGTGGGGATGACGT CAAATCATCATGCCCCTTATGAGCAGGAGGCTACACACGTGCTACAATGGCGTAAACAAAGGGAGGCAGAACCGAGT CGAGCAAATCCCAAAAATAACGTCTCAGTTCGGATTGTAGTCTGCAACTCGACTACATGAAGCTGGAATCGCTAGTAATC GAGCAATCAGAATCGCGGTGAATACGTTCCCGGGTCTTGTACACACCGCCCGTCACACCATGGGAGTTGTAACACCC CGAAGTCAGTGACCCAACCGTAAGGAGGGGAGCGTCCGAAGGTGGGACCGATGACTGGGGTGAAGTCGTAACAAGGTAG CCGTATCGGAAGGTGCGGCTGGATCACCTCCTTCT |
| Tannerella_sp_6_1_58FAA_NCBI_ACWX01000008 | Tannerella_sp_6_1_58FAA | ACWX0100006 8 | SEQ ID NO: 311 | AGAGTTTGATCCTGGCTCAGGATGAACGCTAGCGGCAGGCCTAACACATGCAAGTCGAGGGGCAACATGGTATCAGCTT GCTGATACCGATGGCGACCGGCGCACGGGTGAGTAACGCACGTATACTCACCTGTAACAGAGGGATAACCCGGAGAA ATCCGGACTAATACCCTCATAGCACATATTATTCGCATGAATTTATGTTAAAGAGACTCGGTTACAGATGGGATGAACATGCGTTC CATTAGGTTGTGGCGGTCAGGAGTGAGCCCACCAAGGCGATGATGGATAGGGTTCTGAGAAGGTTCCCCACACTG GTACTGAGACACGGACCAGACTCCTACGGGAGGCAGCAGTGAGGAATATTGGTCAATGGACGAAAGTCTGAACCAGCCA AGTCGCGTGAGGGAAGAAGGCCCTTACGGGTTGTAAACTCCTTTTGTTAGGGAGCAAGCGTAATGTGACGGTACCTGA ATTTATTGGGTTTAAAGGGTGCGTAGGCTGGATAAAAGAGCGGAAATGCTTGGTGTGAAATGCATATATCACGAAC TGAAACTGTTTTCTAGAGTATAAAGGGACACGAACAACTTACCCAGCAGCATACGGGGAATAAATCGACAGGATTAGAT ACCCTGGTAGTCCACGCAGTAAACGATGATAAACGTGCCGATACGTTTGCGATATAAGCGAAAGCGTAAGCGAAAC GAAAGCGAAATCCACCTGGGGAGTACGCCGGCAACGGTGAAACTCAAAGGAATTGACGGGGGCCCGCACAAGCGGAGG AACATGTGGTTTAATTCGATGATACGCGAGGAACCTTACCCGGGCTTGAAGCGCAGAGGAATGACAGGTCAGTGATAC GTCTGACGTCTTCGGACCTGCGCATGCCAAGGTGTCTGTATCGGGCCTGCGCGAAGGTGACCCTAGTGAAGGTGTAAC CCGCTGTCGCTGCTGCTGCTGAGGAACGCGGATAATACGAGCGCAACCC |

FIG. 16AAAAU

```
TTACCGGTAGTTACTAACAGGTCAAGCTGAAGGACTCTACCGGACTGCCAGCGCAAGCTGTGAGGAAGGTGGGATGA
CGTCAAATCAGCACGGCCCTTACGTCCGGGGACACACGTGTTACAATGGCAGGTACAGAGAGTCGCGGCGTAGCAA
TACGTAGCCAATCCCGAAAACCTGTCTCAGTTCGGATCGGAGTCTGCAACCCGACTCCGTGAAGCTGAATTCGCTAGT
AATCGGCGCATCAGCGATGGCGGCGGTGAATACGTTCCCGGGCCTTGTACACACCGCCCGTCAAGCCATGGGAGCCGGGA
GTACCTGAAGTATGCAACCGCAAGGAGGTCCTAGGGTAATACTGGTGACTGGGGCTAAGTCGTAACAAGGTAGCCGTA
CCGGAAGGTGCGGCTGGAACACCT
```

COMPOSITIONS AND METHODS FOR TREATING CHOLESTATIC DISEASE

REFERENCE TO A SEQUENCE LISTING SUBMITTED ELECTRONICALLY

The content of the electronically submitted sequence listing in ASCII text file (Name: 4268_0430001_Seqlisting_ST25.txt; Size: 651,726 bytes; and Date of Creation: Aug. 4, 2020) filed with the application is herein incorporated by reference in its entirety.

FIELD OF THE INVENTION

This invention relates to compositions and methods for use in the treatment and prevention of cholestatic diseases.

BACKGROUND

Cholestatic diseases are conditions that result in a toxic accumulation of bile in the liver, and impaired liver function as evidenced by elevated levels of liver enzymes in serum. This can be caused through direct blockage of extrahepatic bile ducts (e.g., by gallstone, inflammatory stricture, cancer, or pancreatitis) or damage to intrahepatic bile ducts caused by conditions such as primary biliary cirrhosis (PBC), primary sclerosing cirrhosis (PSC), progressive familial intrahepatic cholestasis, cholestasis of pregnancy, cholangitis, liver diseases, such as hepatitis, alcoholic liver disease, non-alcoholic steatohepatitis (NASH), and hepatocellular carcinoma, and other causes of liver cirrhosis, such as cystic fibrosis and graft vs. host disease.

Ursodeoxycholic acid (UDCA) has been reported as a treatment for cholestatic liver diseases such as PBC and PSC. UDCA is believed to delay disease progression through its anti-cholestatic, anti-inflammatory, anti-apoptotic, and protective properties (Paumgartner et al., Hepatology 36:525-531, 2002). However, for PBC, about 40% of patients fail to respond to UDCA treatment (Pares et al., Gastroenterology 130:715-720, 2006). Furthermore, the treatment can have severe side effects, particularly when administered at high dosages. In PSC, high doses were associated with risk of significant adverse events. Obeticholic acid, a non-natural bile acid derivative, has been approved for treating primary biliary cholangitis (PBC) in combination with UDCA in adults with an inadequate response to UDCA, or as monotherapy in adults unable to tolerate UDCA, and is being studied in clinical trials for treating PSC. However, the treatment can be associated with undesirable side effects including severe pruritus. Patients whose disease is not controlled by pharmacologic intervention often require liver transplantation.

The gastrointestinal (GI) microbiome plays a role in bile acid metabolism, altering liver synthesized conjugated primary bile acids to a range of primary and secondary bile acids that influence metabolism, inflammation, immunity, and bile acid synthesis in the liver and the gastrointestinal (GI) tract. Liver synthesized bile salts include glycine or taurine conjugated cholic acid (CA) and chenodeoxycholic acid (CDCA), which are amphipathic and have detergent properties that help solubilize lipids and other hydrophobic molecules for absorption (Ridlon et al., J. Lipid Res. 47:247-259, 2006). The conjugated primary bile salts (optionally referred to herein as "conjugated primary bile acids") are deconjugated by certain gut bacteria to form deconjugated primary bile acids (referred to herein as "primary bile acids") that can be further metabolized into secondary bile acids through a series of microbially catalyzed reactions, including oxidation, isomerization, and 7α-dehydroxylation (Ridlon et al., J. Lipid Res. 47:247-259, 2006). In addition, the liver produces conjugated forms of these bile acid metabolites (referred to herein as "conjugated secondary bile acids"). In total, more than 45 species of bile acids have been reported to be found in humans (Bathena et al., J. Chromatography B 942-943:53-62, 2013). Changes in bile acid content and signaling have been associated with a number of disease outcomes including cholestatic disease, NASH, and inflammatory diseases such as inflammatory bowel disease (Hofmann, Arch Intern Med 159:2647-2658, 1999; Duboc et al., Gut 63:531-539, 2013; Kohli et al., Dig. Dis. 33:440-446, 2015).

While conjugated primary bile salts are important for proper nutrient absorption, when present at high concentrations or when unable to form micelles, they can cause damage to hepatocytes and biliary epithelial cells (Monte et al., World J. Gastroenterol. 15(7):804-816, 2009). Elevated levels of bile acids have also been shown to cause oxidative stress and apoptosis in the liver (Sokol et al. Hepatology 17:869-881, 1993; Faubion et al., Fas. J. Clin. Invest. 103:137-145, 1999) and the more hydrophobic bile acids have been associated with carcinogenesis in the colon (Debruyne et al., Mutat. Res. 480-481:359-369, 2001). Disrupted FXR signaling and bile acid content has also been associated with liver cancer (Kim et al., Carcinogenesis 28:940-946, 2007). In humans, a defect in the MDR3 gene results in a type of cholestasis known as Progressive Familial Intrahepatic Cholestasis (Deleuze et al., Hepatology 23:904-908, 1996).

Given the limited availability of effective treatment options and chronic progression of disease, there is a need for treatments to ameliorate or prevent cholestatic diseases and their signs and symptoms.

SUMMARY

The invention provides formulations including a plurality of viable bacteria, wherein the formulation includes at least one bacterial OTU or species that can exhibit a first bile metabolizing activity (e.g., a bile acid or bile salt hydrolase activity; also see below), and a pharmaceutically acceptable excipient.

In some embodiments, the 16S rDNA sequence, or a fragment thereof, of the OTU or species is at least 95% or at least 97% identical (e.g., at least 98%, at least 99%, or 100% identical) to a sequence in FIGS. 16A-16AAAAU, or a portion thereof (see, e.g., below).

In some embodiments, the formulations further include at least one viable bacterial OTU or species that can exhibit an activity selected from the group consisting of a second bile acid or bile salt hydrolase activity having a specificity different from the first bile acid or bile salt hydrolase activity, deconjugation, oxidation, and dehydroxylation.

In some embodiments, the formulations includes at least two different bacterial OTUs or species.

In some embodiments, the formulations include two different bacterial OTUs or species and the formulation can exhibit oxidation and dihydroxylation activities.

In some embodiments, the formulations include at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 40, 45, or 50 OTUs or bacterial species selected from at least two clades of Table 1. In various examples, the 16S rDNA of each of the OTUs or bacterial species of the composition of Table 1 has at least 95% or 97% sequence identity (e.g., at least 98%, at least 99%, or 100% identity) to at least one sequence of FIGS. 16A-16AAAAU, or a portion thereof (see, e.g., below).

In some embodiments, the formulations include at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 40, or 50 OTUs or bacterial species selected from at least two clades of Table 2.

In some embodiments, the formulations include at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 40, or 50 OTUs or bacterial species of part B or C of Table 1, Table 2, or Table 3.

In some embodiments, the formulations include one or more OTUs or bacterial species from 5, 10, 15, or 20 clades selected from the group consisting of: 1, 6, 86, 87, 90, 100, 101, 164, 195, 196, 197, 203, 204, and 297.

In some embodiments, the number of different OTUs or species in the formulations is fewer than 60, 50, 30, 20, or 15.

In some embodiments, the bile acid or bile salt hydrolase, deconjugation, oxidation, or dehydroxylation activity of one or more bacterial OTU or species of the formulation is detected using an animal-based assay, a cell-based assay, an in vitro assay, by sequencing, or using a combination of these types of assays.

In some embodiments, each bacterial OTU or species of the formulations has a bile acid or bile salt metabolism activity selected from the group consisting of hydrolysis, deconjugation, oxidation, or dehydroxylation.

The invention also includes therapeutic formulations or compositions including a formulation described above or elsewhere herein. In various embodiments, the viable bacteria of the therapeutic formulations are delivered to the small intestine, the colon, or both.

Also provided by the invention are methods of treating a subject diagnosed with or at risk for a cholestatic disease or condition, the methods including administering to the subject a microbial composition or formulation (see, e.g., the formulations described above), wherein at least one bacterial OTU or species in the microbial composition can deconjugate a primary bile acid or bile salt. In various embodiments, at least one OTU or bacterial species in the microbial composition can metabolize a primary bile acid or salt to a secondary bile acid or salt. In various embodiments, the 16S rDNA sequence of the OTU is at least 95% identical (e.g., at least 98%, at least 99%, or 100% identical) to a sequence in FIGS. 16A-16AAAAU, or a portion thereof (see, e.g., below).

The invention further provides methods of treating a subject diagnosed with or at risk for a cholestatic disease or condition, the methods including administering to the subject a formulation as described above or elsewhere herein.

In various embodiments of the methods described herein, the subject is diagnosed with or at risk for general cholestasis (GC), primary sclerosing cirrhosis (PSC), primary biliary cirrhosis (PBS), progressive familial intrahepatic cholestasis (PFIC), non-alcoholic fatty liver disease (NAFLD), non-alcoholic steatohepatitis (NASH), cholestasis of pregnancy, cholangitis, hepatitis, alcoholic liver disease, hepatocellular carcinoma, liver cirrhosis, cystic fibrosis, graft-versus-host disease (GVHD), or blockage of an extrahepatic bile duct. In various embodiments, the blockage of an extrahepatic bile duct is due to gall stone, inflammatory stricture, cancer, or pancreatitis.

The invention also provides methods of treating a subject diagnosed with or at risk for a cholestatic disease or condition (see, e.g., the list set forth above) and prescribed obeticholic acid (OCA), ursodeoxycholic acid (UDCA), or a derivative of obeticholic acid or UDCA, the method including administering to the subject: (i) a composition including one or more of CDCA, a bacterium that has BSH activity, or a compound that can inhibit one or both of and/or activity; and (ii) a pharmaceutically acceptable excipient.

The invention additional includes compositions containing hyocholic acid or a bacterium that can increase the concentration of hyocholic acid.

The invention further includes methods of treating a subject diagnosed with or at risk for a cholestatic disease or condition (see, e.g., the list set forth above), the methods including administering to the subject UDCA and a composition including a bacterium that has BSH activity, but does not increase lithocholic acid (LCA) levels. In various embodiments, the composition further includes a bacterium that can metabolize a primary bile acid or salt to a secondary bile acid or salt.

Also provided in the invention are compositions including a bacterium that has BSH activity, for use in treating a subject being treated with UDCA, wherein the bacterium does not increase LCA levels. In various embodiments, the composition further includes a bacterium that can metabolize a primary bile acid or salt to a secondary bile acid or salt.

In some embodiments, the methods further include administering OCA to the subject.

In some embodiments of any of the formulations and methods described herein, the microbial composition is directly derived from human feces, is a designed composition, comprises bacterial spores, or comprises spore forming bacteria.

The invention further provides compositions including a formulation as described above and elsewhere herein for use in treating a subject diagnosed with or at risk for a cholestatic disease or condition (see, e.g., the list set forth above).

Also, the invention provides methods for identifying a bacterial species for use in a composition for altering bile acid metabolism in a subject. These methods include comparing protein coding sequences of a bacterial strain to reference sequences in a database of proteins that catalyze a desired bile acid activity, wherein identification of a bacterial strain including a sequence with homology to a reference sequence indicates the identification of a bacterial strain for use in the composition.

In various embodiments, the methods further include testing the bile acid metabolizing activity of a bacterial species using an in vitro assay or an animal model-based assay.

In further embodiments, the level of sequence homology is at least 75%, 80%, 85%, 90%, 93%, 95%, 97%, 98%, 99%, or 100% identity.

As used herein, "augmentation" refers to the establishment or significant increase of one or more types of microbes (e.g., bacteria) that are (i) absent or undetectable (as determined by a method such as genomic sequencing or microbiological techniques) from a therapeutic microbial composition, (ii) absent, undetectable, or present in low frequencies in a host niche (for example, in the gastrointestinal (GI) tract, e.g., the lumen of the GI tract, the mucosa of the GI tract, the colon, the small intestine) prior to administration of the microbial composition, and (iii) are detectable after the administration of the microbial composition or, in cases where the microbes were present at low frequencies prior to administration, significantly increase after administration of the microbial composition; for example 2-fold, 5-fold, $1\times10^2$-fold, $1\times10^3$-fold, $1\times10^4$-fold, $1\times10^5$-fold, $1\times10^6$-fold, $1\times10^7$-fold, or greater than $1\times10^8$-fold. The microbes comprising an augmented ecology can be derived from exogenous sources such as food or other environmental sources, or can be derived from niches within the host where they reside at low frequency. The increase may be in number of a particular type of bacteria, an increase in the diversity of types (e.g., clades, OTUs or species of bacteria), or both. In some embodiments, a reference level is established for comparison to determine "undetectable" or "low" frequencies.

"Clade" refers to the operational taxonomic units (OTUs or members of a phylogenetic tree) that are downstream of a statistically valid node in a phylogenetic tree. Clades are defined based on the topology of a phylogenetic tree that is constructed from full-length 16S rDNA sequences using maximum likelihood methods. Clades are constructed to ensure that all OTUs in a given clade are within a specified number of bootstrap supported nodes from one another, and have genetic similarity based on full-length 16S rDNA sequence. OTUs that are within the same clade can be distinguished as genetically and phylogenetically distinct from OTUs in a different clade based on, e.g., 16S rDNA sequences. Accordingly, species within a single clade are likely to have conserved ecological function and may be interchangeable in a composition.

"Dysbiosis" refers to a state of the microbiota of the GI tract or other body area in a subject, including mucosal or skin surfaces, in which the normal or healthy diversity and/or function of the microbial ecological network is disrupted. The disruption results in an unhealthy state of the microbiome that can be due to, e.g., a decrease in diversity of the microbiome, the overgrowth of one or more pathogens or pathobionts, the presence of symbiotic organisms that are able to cause disease only when certain genetic and/or environmental conditions are present in a subject, or the shift to microbiome that no longer provides one or more essential functions to the host subject, and therefore no longer promotes health, or a change in the balance of one or more metabolic functions. A dysbiosis can be caused, e.g., by the use of antibiotics to treat or prevent an infection. In some cases, a dysbiosis is related to an alteration in host physiology, for example, a decrease in enterohepatic bile circulation, e.g., due to dysfunction of hepatobiliary system. In some cases, a dysbiosis is associated with an inflammatory state, e.g., in PSC or ulcerative colitis.

"Engraftment" refers to the establishment of a bacterial type (e.g., a bacterial clade, OTU, or species) present in a therapeutic composition in a target niche such as the GI tract (e.g., the small intestine or the large intestine) of a host treated with the composition, and wherein the bacterial type was absent or undetected in the treated host prior to treatment. Engrafted species or OTUs can establish as measured from administration of the final dosage or a treatment (for example, 1 day, 2 days, 3 days, 4 days, 5 days, 6 days, 1 week, 2 weeks, 3 weeks, 4 weeks, 8 weeks, 12 weeks, 3 months, or 6 months). Methods of detection are known in the art and include qPCR, 16S v4 Next-Generation Sequencing (NGS) and Whole Metagenomic Sequencing (WMS) and other methods of high throughput sequencing. Detection limits can be, for example, detection of one bacterium in 10e6, one in 10e7, or one in 10e8. In some embodiments, the method of detection can selectively detect a strain of bacterium provided in a composition. In some embodiments, the method of detection can selectively detect a species or OTU of a bacterium provided in a composition. Without committing to any particular theory, an engrafted population of microbes may induce an environmental shift in the target niche, thereby promoting favorable conditions for the growth of commensal microbes capable of catalyzing a shift from a dysbiotic ecology to one more representative of a healthy state.

As used herein, "treating" and "treatment" refer to the administration of an agent, composition, or formulation to an individual diagnosed with or predicted to be at risk for a disease to prevent or ameliorate at least one sign or symptom of the disease. The terms "disorder" and "disease" are used interchangeably herein. The terms "preventing" and "prevention" refer to the administration of an agent or composition to a clinically asymptomatic individual who is susceptible to a particular adverse condition, disorder, or disease, and thus relates to the prevention of the occurrence of at least one sign or symptom of a disease. As used herein, unless indicated otherwise, the term "symptom" includes signs and symptoms.

A "therapeutically effective amount" or an "effective amount" of an agent, composition, formulation, or combination thereof is a sufficient amount of the agent, composition, formulation, or combination thereof to prevent or ameliorate at least one symptom of a disorder. A therapeutically effective amount of a therapeutic composition described herein can vary according to factors such as the disease state, age, sex, and weight of the individual, and the ability of the therapeutic composition to elicit a desired response in the individual, e.g., amelioration of at least one disorder parameter, or amelioration of at least one sign or symptom of the disorder (and optionally, the effect of any additional agents being administered). A therapeutically effective amount is also one in which any toxic or detrimental effects of the composition are outweighed by the therapeutically beneficial effects. A composition as described herein is generally administered in a therapeutically effective amount. Symptoms of, or associated with, cholestatic diseases are known in the art. For example, symptoms of general cholestasis are known in the art and can include, e.g., pruritus, jaundice, enlarged liver and spleen, fatigue, nausea and vomiting, cirrhosis, liver failure, liver cancer, gallstones, and biochemical markers of such symptoms.

"Types" of bacteria refers to bacteria grouped by strain, species, clade, family, or other organizational categories. In some embodiments, a bacterial species is defined as bacteria having at least one 16S rDNA sequence that is at least 95%, at least 97%, at least 98%, at least 99%, or at least 100% identical to a 16S rDNA sequence of a reference bacterium. In some cases, a bacterial species is defined as bacteria having at least one variable region of a 16S rDNA sequence (V1-V8), e.g., a V4 or V6 region, that is at least 95%, at least 97%, at least 98%, at least 99%, or at least 100% identical to a corresponding 16S rDNA variable region of a reference bacterium.

The entire disclosure of each patent document and scientific article referred to herein, and those patent documents and scientific articles cited thereby, is expressly incorporated by reference herein for all purposes.

Additional features and advantages of the invention are more particularly described below.

BRIEF DESCRIPTION OF THE DRAWINGS

FIGS. 1A and 1B depict results of in vitro screening of human bacterial isolates and designed compositions for bile acid metabolism. FIG. 1A depicts data illustrating diversity of enzymatic activities and substrate specificities in bacterial species and individual strains. Each row corresponds to an individual strain tested. Columns depict the five categories of enzymatic activities encompassed by the screening approach, and bile acid substrates used for screening. Darkened squares indicate the presence of enzymatic activity on the indicated substrate, while blanks indicate no activity. FIG. 1B depicts designed compositions and their constituent strains and bile acid activities. Rows indicate individual strains within indicated compositions. Columns indicate enzymatic activity and substrate specificity for each strain. Strains were also tested as mixtures of complete compositions to confirm activities. At least one 16S rDNA sequence useful for identifying species is provided in FIGS. 16A-16AAAAU.

FIG. 6A: hFXR reporter cells were incubated for 24 hours with serial dilutions of either CDCA (0-100 μM), OCA (0-10 μM), or OCA (0-10 μM) with a constant concentration of 50 μM CDCA. FXR activation was assessed by measurement of luciferase activity and is represented as fold change over vehicle control (0.2% DMSO). Each dose was performed in triplicate. FIGS. 7C and 7D. OCA activated FXR signaling and modulated expression of FXR-dependent genes in a dose dependent manner. FXR signaling was assessed by measurement of expression of down-stream genes included Cyp7A1 in the liver and FGF15 in the ileum.

FIG. 7B depicts the results of experiments demonstrating synergistic activation of FXR by hyocholic acid (HCA) the presence of 50 μM CDCA ($EC_{50}$ of CDCA=50 μM as shown in FIG. 7A) in a luciferase based in-vitro FXR activation assay. DCA and LCA showed no significant synergistic effects with HCA. LCA at 100 μM with CDCA at 50 μM showed no difference in fold activation due to increased toxicity to cells. Data are expressed as fold change relative to 50 μM CDCA alone.

FIGS. 8A and 8B depict the results of experiments showing changes in total bile acid levels and bile acid composition in patients with Primary Sclerosing Cholangitis (PSC). FIG. 8A: Patients show decreased total bile acid levels in bile with corresponding increases in total portal blood and peripheral blood bile levels. FIG. 8B: PSC patients show decreases in the proportions of secondary and conjugated secondary bile acids typically generated by the gut microbiome, with significant increases in the corresponding upstream conjugated primary bile acids. Bile acid concentrations were measure using LC-MS with appropriate reference standards for quantitation. Data is depicted as mean±standard deviation. * indicates a significant difference between PSC and healthy patients, based on a two-way Anova with a Tukey's multiple comparisons test. P-values are as indicated: *$p \leq 0.1$, $p \leq 0.01$, *$p \geq 0.001$ ****$p \leq 0.0001$.

FIGS. 9A-9G show the results of experiments in which conventionally housed mice treated with DDC-diet induced cholestatic disease showed altered bile acid content and gut microbial profile as compared to healthy controls. FIG. 9A: Significantly increased levels of serum biomarkers in DDC treated conventionally housed Swiss albino mice, including Alkaline Phosphatase (ALP), Alanine Aminotransferase (ALT), Total Bilirubin (TBIL) and Cholesterol (CHOL), confirming the presence of cholestatic liver disease. FIGS. 9B-9D: Mice with DDC-diet induced cholestatic disease show decreased levels of 2° and conjugated 2° bile acids, with corresponding increases in upstream conjugated 1° bile acids compared to untreated controls. FIG. 9E: Alpha diversity and beta diversity indices show distinct microbial populations in mice pre (d0) and post (d21) DDC treatment to induce cholestatic disease. Alpha diversity (left graph) is a measure of species richness based on a Shannon diversity index, while beta-diversity (right graph) is depicted as distance of separation on two weighted axis based on a principle coordinate analysis (PCoA). FIG. 9F: List of species with significantly different prevalence (p≤0.2) between mice pre (d0) and post (d21) treatment with DDC to induce cholestatic disease. FIG. 9G: Significant loss of strains with known 7α-dehydroxylation activity with cholestatic disease development in conventional Swiss albino mice. * indicates a significant difference between DDC treated and control mice (A-D) or between mice pre (d0) and post (d21) DDC treatment. Significance analysis based on a two-way Anova with a Tukey's multiple comparisons test. P-values are as indicated: *p≤0.1, p≤0.01, *p≤0.001 ****p≤0.0001

FIG. 10E shows the results of bile acid profiling, which determined that FMT treatment was sufficient to restore bile acid composition in the gut compared to germ-free mice. * indicates a significant difference relative to GF mice on DDC treatment. Significance analysis based on a two-way Anova with a Tukey's multiple comparisons test. P-values are as indicated: *p≤0.1, p≤0.01, *p≤0.001 ****p≤0.0001

FIGS. 11A-11B: Germ-free C57Bl/6 and Swiss albino mice show comparable susceptibility to liver disease induced body weight loss despite significant resistance of conventional Swiss albino mice to disease. FIG. 11C: On a DDC diet, colonization of germ-free Swiss albino mice with conventional C57Bl/6 donor mice FMT results in more rapid weight loss than in Swiss albino mice receiving FMT from conventional Swiss albino donor mice. FIG. 11D: Serum ALP levels remain comparable between mice colonized with FMTs from different donors, despite differences in body weight loss prior to terminal collection. FIG. 11E: C57Bl/6 donor FMT colonized mice have significantly higher levels of 1° bile acids and lower levels of the 2° bile acids compared to Swiss albino donor FMT colonized mice. (*Note, for FIG. 11A, GF-C57 mice were part of a separate experiment from the other three arms.)

FIG. 12C: Colonization with either a conventional mouse derived FMT or a designed composition (Max BA) restored the majority of fecal bile acid subsets in germ-free mice. * indicates a significant difference relative to GF mice on DDC treatment. Significance analysis based on a two-way Anova with a Tukey's multiple comparisons test. P-values are as indicated: *p≤0.1, p≤0.01, *p≤0.001 ****p≤0.0001

FIGS. 16A-16AAAAU show a listing of full-length 16S rDNA sequences from exemplary bacteria useful in various compositions and methods of the invention.

DETAILED DESCRIPTION

Figure 2:
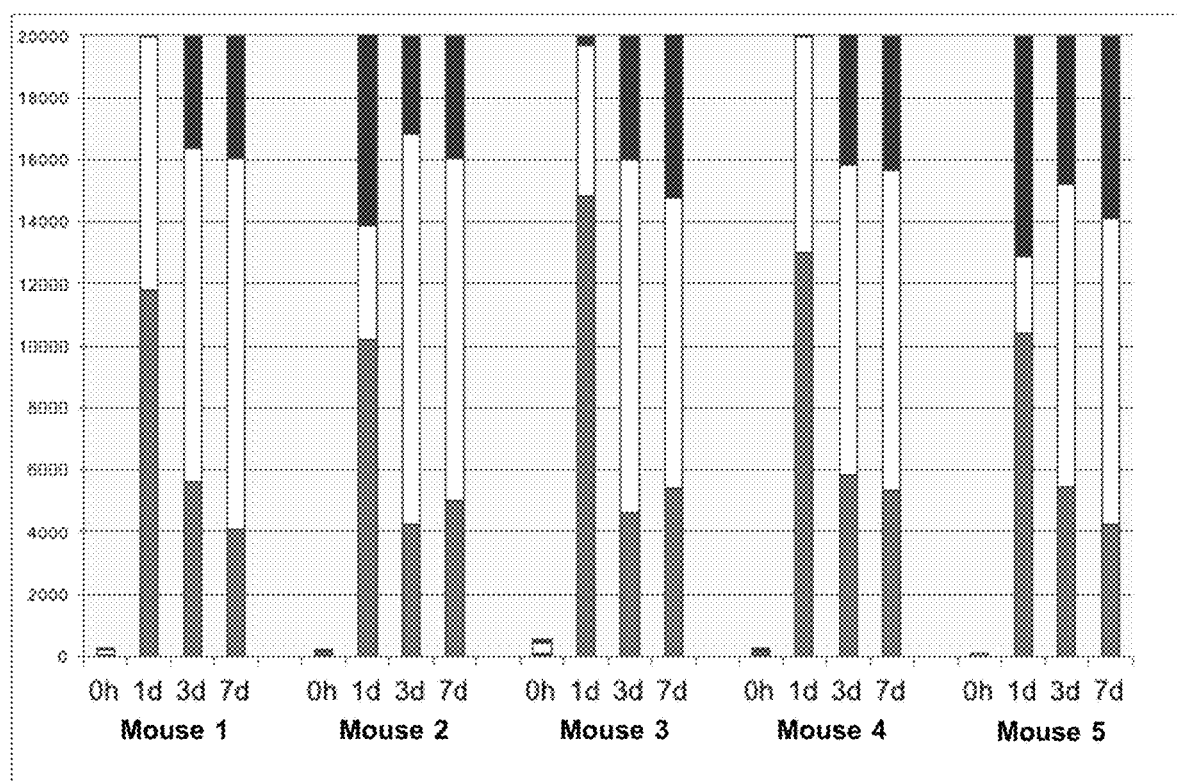
FIG. 2 depicts NGS data from an experiment in which germ-free mice were colonized with a No BA composition. Fecal samples from five mice, collected prior to dosing and 1 day, 3 days, and 7 days post-dosing with a "no bile acid activity" composition were analyzed by Next-Generation Sequencing (NGS). The y-axis indicates the number of reads observed up to 20,000 reads for each sample. Individual clades are represented by different shading in the bar graphs. The three clades belonging to the bacteria in the "no bile acid" composition are shown as dark gray, white, and light gray.

The invention provides methods and compositions for use in the prevention, amelioration, and treatment of cholestatic diseases. According to the methods of the invention, the microbiome of a treated subject is altered to affect bile acid metabolism by the administration of a bacterial composition, such as a composition described herein. In some embodiments, the bacterial composition is used in combination with a pharmaceutical. In some embodiments, the pharmaceutical dosage or regime, when administered with the composition, is reduced in amount as compared to treatment with the pharmaceutical alone. In some embodiments, the efficacy of the pharmaceutical is increased and/or side effects are reduced by treatment with a composition of the invention.

Microbiome mediated bile acid metabolism in the GI tract involves deconjugation of conjugated primary bile acids, a process by which the polar taurine or glycine groups are removed from conjugated primary bile salts, generating primary bile acids (Ridlon et al., J. Lipid Res. 47:247-259, 2006). Decreasing concentrations of conjugated primary bile salts can significantly influence the effects and/or progression of cholestatic diseases in which a patient has an undesirable level of conjugated bile acids. Furthermore, a composition can cause additional effects due to increased levels of primary and/or secondary bile acids, which have signaling properties, e.g., in epithelial cells, immune cells, and the liver. Manipulating bile acid pathways can have a therapeutic benefit, as evidenced by reports that OCA can be of therapeutic benefit to patients with cholestasis. As described below, in some embodiments, a composition of the invention comprises one or more bacterial species or OTUs that can express at least one bile salt hydrolase (BSH).

Primary bile acids are the products of deconjugation of conjugated primary bile salts. Examples of primary bile acids are cholic acid (CA) and chenodeoxycholic acid (CDCA). CA and CDCA are ligands for farnesoid X receptor (FXR), a nuclear hormone receptor that regulates bile acid production in the liver. FXR regulates bile acid homeostasis by downregulating bile acid synthesizing enzymes CYP7A1 and CYP8B1 (Sinai et al., Cell 102:731-744, 2000). Activation of FXR signaling represses bile acid synthesis and increases bile acid export from the liver, thereby reducing hepatic accumulation and liver damage by potentially toxic bile acids (Chiang, Compr. Physiol. 3:1191-1212, 2013). Reduction in bile acid synthesis can be mediated both directly in the liver and indirectly through the GI tract by an FXR-FGF15/19-FGF4R pathway, both of which are mediated by bile acid signaling. FGF19 is the human ortholog of murine FGF15. FXR signaling is also believed to have an anti-inflammatory component through its actions on NF-κB signaling (Chiang, Compr. Physiol. 3:1191-1212, 2013). Molecules targeting the nuclear hormone receptor FXR (NR1H4) are in development for treating cholestatic liver diseases, e.g., OCA. Accordingly, in some embodiments, compositions and methods of the invention relate to compositions that include one or more bacteria that can metabolize conjugated primary bile salts to primary bile acids and, optionally, can also metabolize primary bile acids to secondary bile acids.

In some embodiments, microbiome synthesized primary bile acids, such as cholic acid (CA) and chenodeoxycholic acid (CDCA), are the primary endogenous ligands for FXR and therefore play a significant role in reducing the concentrations of conjugated primary bile acids and their synthesis. The resulting primary and secondary bile acids can function to prevent hepatic accumulation of conjugated bile acids, as well as damage from potentially toxic bile acids. The invention thus provides bacterial compositions, including designed compositions, which alter bile acid metabolism along targeted pathways which influence endogenous signaling in the ileum and liver. The compositions and methods of the invention are described in more detail, as follows.

Compositions

Compositions of the invention comprise microbes, e.g., bacteria, which have been identified in the gastrointestinal tract of a healthy mammal, e.g., a human. In some embodiments, the types of bacteria useful in a composition are types identified in the small intestine (e.g., the human small intestine). In some cases, the types of bacteria are those identified primarily in the colon. Some embodiments include mixed populations of bacteria (e.g., small intestine and colon derived bacteria). In some cases, the composition is derived from a fecal preparation, e.g., a preparation directly derived from human feces. "Directly derived" from human feces means that the bacteria of the composition are isolated from human feces with little or no culturing of such bacteria.

In some embodiments, the composition comprises bacteria derived from single species axenic cultures. Selected species from such cultures are combined to produce a composition. Such a composition is termed herein, a "designed composition." In some cases, the bacteria from cultures are induced to form spores and such spores are used in the composition. Bacteria in designed compositions are generally species that have been identified in healthy human feces. Examples of designed compositions are described infra.

In some embodiments, the composition comprises bacteria that can metabolize one or more conjugated primary bile salts to primary bile acids by removing taurine and/or glycine conjugations and/or bacteria that can metabolize one or more primary bile acids to secondary bile acids through hydrolysis, oxidation, reduction, hydroxylation, epimerization, 7-alpha-dehydroxylation (through a series of CoA-ligation, oxidation, and/or dehydration reactions), desulfation, as well as dimerization of bile acids. For example, certain compositions of the invention include bacteria that can express bile salt hydrolase (BSH) activity, and therefore can be used to increase deconjugation of conjugated primary bile salts, e.g., in the gastrointestinal tract. Other compositions include bacteria that have activities including not only bile salt hydrolase activity, but also bile acid oxidation and 7-alpha-dehydroxylation. Bacteria able to express specific functions can be selected to achieve the desired alteration in bile acids. For example, bacteria can be selected for their ability to express functional BSH, 7α-dehydroxylase, α-hydroxysteroid dehydrogenase (α-HSDH), β-hydroxysteroid dehydrogenase, or other enzymes able to metabolize a bile acid. It is to be noted that in some cases the activity is effected by an operon having more than one specific activity, e.g., 7α-dehydroxylation, resulting in metabolism of a hydroxyl bile acid to a dehydroxy bile acid. Bacteria or combinations of bacteria are selected for their ability to, e.g., decrease the amount of one or more conjugated primary bile salts (e.g., glycocholic acid, taurocholic acid, glycochenodeoxycholic acid, taurochenodeoxycholic acid, tauro-α-muricholic acid, or tauro-β-muricholic acid). In some embodiments, bacteria or combinations of bacteria are selected for their ability to decrease or increase the amount of one or more primary or secondary bile acids, (e.g., cholic acid, deoxycholic acid, oxocholic acid (3-, 7-, or 12-), isocholic acid, chenodeoxycholic acid, lithocholic acid, oxochenodeoxycholic acid (3- or 7-), isochonedeoxycholic acid, α-muricholic acid, β-muricholic acid, γ-muricholic acid (also known as hyocholic acid). Bile acids can be assayed using LC-MS as described herein and is known in the art, thin layer chromatography, GC-mass spectrometry, or other methods known in the art.

Compositions described herein generally comprise at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 40, 45, or 50 types of bacteria. A bacterial type can be a family, genus, clade, species, or strain. In one example a composition comprises at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 40, 45, or 50 different bacterial species. In another example, a composition comprises bacteria from at least 2, 3, 4, 5, 6, 7, 8, 9, 10, 11, 12, 13, 14, 15, 16, 17, 18, 19, or 20 different clades. In more specific examples, a composition comprises at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 40, 45, or 50 different species from part B or C of Table 1, Table 2, or Table 3; or species from at least 5, 10, 15, or all 18 of each of clades the clades listed in Table 1: 1, 6, 86, 87, 90, 100, 101, 164, 195, 196, 197, 203, 204, and 297. In some embodiments, a bacterial species is identified by homology to a reference sequence (e.g., a 16S rDNA sequence). In general, a bacterial strain having at least 97% identity (e.g., at least 98%, at least 99%, or 100% identity) to a 16S rDNA sequence (the entire sequence or to a variable region(s) such as V4 or V1-3) of a species' reference sequence is the same species as the reference species. An exemplary list of such reference sequences is provided in FIGS. 16A-16AAAAU. In some embodiments, the number of different OTUs or species in the compositions is fewer than 60, 50, 30, 20, or 15. Typically, a composition is formulated in a pharmaceutically acceptable excipient (see below).

For purposes of the inventions described herein, clades are groupings of evolutionarily related bacterial species. Because of their relatedness, bacteria within a clade have a higher than average likelihood of sharing functional features such as bile acid metabolism. Clades are defined based on the topology of a phylogenetic tree that is constructed from full-length 16S sequences using maximum likelihood methods familiar to individuals with ordinary skill in the art of phylogenetics. Clades are constructed to ensure that all OTUs in a given clade are: (i) within a specified number of bootstrap supported nodes from one another, and (ii) within 5% genetic similarity. OTUs that are within the same clade can be distinguished as genetically and phylogenetically distinct from OTUs in a different clade based on 16S-V4 sequence data, while OTUs falling within the same clade are closely related. Compositions substituting one species or OTU with another from the same clade are likely to have conserved ecological function and therefore are useful in the present invention. In some embodiments, bacteria useful in the invention can be selected based on presence in a clade containing one or more bacteria demonstrated to exhibit a specific function and further testing as is known in the art and exemplified herein. In some embodiments, the composition comprises one, two, or three species from five, ten, fifteen, or all 18 clades in Table 1. An exemplary list of species in the clades is provided in Table 2. Table 3 is a list of different bacterial species and an indication of the bile acid metabolizing activities of each. When it is indicated herein that species from Table 3 are included in a composition or formulation of the invention, optionally the species includes one or more of the indicated bile metabolizing activities noted in Table 3. Compositions may also be identified by selecting related organisms based on clades and then testing them for the desired activity according to the methods used to identify bacteria in Table 3. Note that in Table 3, blank cells indicate activities that were not tested for in the corresponding strain.

TABLE 1

| Genus | Species | Clade |
|---|---|---|
| A. No bile acid composition | | |
| Bacteroides | Bacteroides stercoris | 203 |
| Parabacteroides | Parabacteroides merdae | 164 |
| Tyzzerella | Clostridium nexile (T. nexile) | 87 |
| B. Bile salt hydrolase (BSH) composition | | |
| Bacteroides | Bacteroides sp. D20 | 204 |
| Bacteroides | Bacteroides uniformis | 204 |
| Blautia | Blautia wexlerae | 197 |
| Bifidobacterium | Bifidobacterium pseudocatenulatum | 297 |
| Eubacterium | Eubacterium rectale | 6 |
| Ruminococcus | Ruminococcus lactaris | 86 |
| Parabacteroides | Parabacteroides distasonis | 164 |
| C. Maximal activity composition | | |
| Bacteroides | Bacteroides sp. 3_1_23 | 196 |
| Collinsella | Collinsella aerofaciens | 100 |
| Eubacterium | Eubacterium limosum | 1 |
| Blautia | Blautia wexlerae | 197 |
| Bacteroides | Bacteroides sp. D20 | 204 |
| Bacteroides | Bacteroides uniformis | 204 |
| Pseudoflavonifractor | Pseudoflavonifractor capillosus | 101 |
| Terrisporobacter | Clostridium glycolicum | 195 |
| Peptoclostridium | Clostridium ghonii | 195 |
| Clostridia | Lachnospiraceae bacterium 5_1_57FAA (isolate a) | 90 |
| Clostridia | Lachnospiraceae bacterium 5_1_57FAA (isolate b) | 90 |
| Bifidobacterium | Bifidobacterium pseudocatenulatum | 297 |
| Eubacterium | Eubacterium rectale | 6 |
| Ruminococcus | Ruminococcus lactaris | 86 |
| Parabacteroides | Parabacteroides distasonis | 164 |

TABLE 2

Exemplary species in bacterial clades

| Clade | Exemplary Species |
|---|---|
| clade_1 | Anaerofustis_stercorihominis, |
| clade_1 | Eubacterium_barkeri |
| clade_1 | Eubacterium_callanderi |
| clade_1 | Eubacterium_limosum |
| clade_1 | Pseudoramibacter_alactolyticus |
| clade_100 | Collinsella_aerofaciens |
| clade_100 | Collinsella_intestinalis |
| clade_100 | Collinsella_stercoris |
| clade_100 | Collinsella_tanakaei |
| clade_100 | Coriobacteriaceae_bacterium_phl |
| clade_101 | Clostridium_orbiscindens |
| clade_101 | Clostridium_sp_NML_04A032 |
| clade_101 | Clostridium_viride |
| clade_101 | Flavonifractor_plautii |
| clade_101 | Oscillibacter_sp_G2 |
| clade_101 | Oscillibacter_valericigenes |
| clade_101 | Oscillospira_guilliermondii |
| clade_101 | Papillibacter_cinnamivorans |
| clade_101 | Pseudoflavonifractor_capillosus |
| clade_101 | Ruminococcaceae_bacterium_D16 |
| clade_101 | Sporobacter_termitidis |
| clade_164 | Bacteroides_sp_20_3 |
| clade_164 | Bacteroides_sp_3_1_19 |
| clade_164 | Bacteroides_sp_3_2_5 |
| clade_164 | Parabacteroides_distasonis |
| clade_164 | Parabacteroides_goldsteinii |
| clade_164 | Parabacteroides_gordonii |
| clade_164 | Parabacteroides_johnsonii |
| clade_164 | Parabacteroides_merdae |
| clade_164 | Parabacteroides_sp_D13 |
| clade_164 | Parabacteroides_sp_NS31_3 |
| clade_164 | Porphyromonadaceae_bacterium_NML_060648 |
| clade_195 | Clostridium_bartlettii |
| clade_195 | Clostridium_bifermentans |
| clade_195 | Clostridium_difficile |
| clade_195 | Clostridium_ghonii |
| clade_195 | Clostridium_glycolicum |
| clade_195 | Clostridium_hiranonis |
| clade_195 | Clostridium_irregulare |
| clade_195 | Clostridium_mayombei |
| clade_195 | Clostridium_sordellii |
| clade_195 | Clostridium_sp_MT4_E |
| clade_195 | Eubacterium_tenue |
| clade_195 | Peptostreptococcus_anaerobius |
| clade_195 | Peptostreptococcus_stomatis |
| clade_196 | Bacteroides_acidifaciens |
| clade_196 | Bacteroides_caccae |
| clade_196 | Bacteroides_finegoldii |
| clade_196 | Bacteroides_ovatus |
| clade_196 | Bacteroides_sp_1_1_30 |
| clade_196 | Bacteroides_sp_2_1_22 |
| clade_196 | Bacteroides_sp_2_2_4 |
| clade_196 | Bacteroides_sp_3_1_23 |
| clade_196 | Bacteroides_sp_D1 |
| clade_196 | Bacteroides_sp_D2 |
| clade_196 | Bacteroides_sp_D22 |
| clade_196 | Bacteroides_xylanisolvens |
| clade_197 | Blautia_coccoides |
| clade_197 | Blautia_glucerasea |
| clade_197 | Blautia_glucerasei |
| clade_197 | Blautia_hansenii |
| clade_197 | Blautia_hydrogenotrophica |
| clade_197 | Blautia_luti |
| clade_197 | Blautia_producta |
| clade_197 | Blautia_schinkii |
| clade_197 | Blautia_sp_M25 |
| clade_197 | Blautia_stercoris |
| clade_197 | Blautia_wexlerae |
| clade_197 | Clostridium_coccoides |
| clade_197 | Lachnospiraceae_bacterium_6_1_63FAA |
| clade_197 | Ruminococcus_hansenii |
| clade_197 | Ruminococcus_obeum |
| clade_197 | Ruminococcus_sp_5_1_39BFAA |
| clade_197 | Ruminococcus_sp_K_1 |
| clade_204 | Bacteroides_fluxus |
| clade_204 | Bacteroides_helcogenes |

TABLE 2-continued

Exemplary species in bacterial clades

| Clade | Exemplary Species |
|---|---|
| clade_204 | Bacteroides_sp_4_1_36 |
| clade_204 | Bacteroides_sp_AR20 |
| clade_204 | Bacteroides_sp_D20 |
| clade_204 | Bacteroides_sp_F_4 |
| clade_204 | Bacteroides_uniformis |
| clade_297 | Bifidobacterium_adolescentis |
| clade_297 | Bifidobacterium_angulatum |
| clade_297 | Bifidobacterium_animalis |
| clade_297 | Bifidobacterium_bifidum |
| clade_297 | Bifidobacterium_breve |
| clade_297 | Bifidobacterium_catenulatum |
| clade_297 | Bifidobacterium_dentium |
| clade_297 | Bifidobacterium_gallicum |
| clade_297 | Bifidobacterium_infantis |
| clade_297 | Bifidobacterium_kashiwanohense |
| clade_297 | Bifidobacterium_longum |
| clade_297 | Bifidobacterium_pseudocatenulatum |
| clade_297 | Bifidobacterium_pseudolongum |
| clade_297 | Bifidobacterium_scardovii |
| clade_297 | Bifidobacterium_sp_HM2 |
| clade_297 | Bifidobacterium_sp_HMLN12 |
| clade_297 | Bifidobacterium_sp_M45 |
| clade_297 | Bifidobacterium_sp_MSX5B |
| clade_297 | Bifidobacterium_sp_TM_7 |
| clade_297 | Bifidobacterium_thermophilum |
| clade_297 | Gardnerella_vaginalis |
| clade_6 | Abiotrophia_defectiva |
| clade_6 | Abiotrophia_sp_oral_clone_P4PA |
| clade_6 | Aerococcus_sanguinicola |
| clade_6 | Aerococcus_urinae |
| clade_6 | Aerococcus_urinaeequi |
| clade_6 | Aerococcus_viridans |
| clade_6 | Butyrivibrio_fibrisolvens |
| clade_6 | Catonella_genomosp_P1_oral_clone |
| clade_6 | Catonella_morbi |
| clade_6 | Catonella_sp_oral_clone_FL037 |
| clade_6 | Eremococcus_coleocola |
| clade_6 | Eubacterium_rectale |
| clade_6 | Eubacterium_sp_oral_clone_GI038 |
| clade_6 | Facklamia_hominis |
| clade_6 | Granulicatella_sp_M658_99_3 |
| clade_6 | Lachnobacterium_bovis |
| clade_6 | Roseburia_inulinivorans |
| clade_86 | Clostridium_glycyrrhizinilyticum |
| clade_86 | Clostridium_oroticum |
| clade_86 | Clostridium_sp_D5 |
| clade_86 | Eubacterium_contortum |
| clade_86 | Eubacterium_fissicatena |
| clade_86 | Lachnospiraceae_bacterium_1_1_57FAA |
| clade_86 | Lachnospiraceae_bacterium_1_4_56FAA |
| clade_86 | Lachnospiraceae_bacterium_8_1_57FAA |
| clade_86 | Ruminococcus_lactaris |
| clade_86 | Ruminococcus_torques |
| clade_90 | Clostridium_hylemonae |
| clade_90 | Clostridium_scindens |
| clade_90 | Dorea_formicigenerans |
| clade_90 | Dorea_longicatena |
| clade_90 | Lachnospiraceae_bacterium_2_1_46FAA |
| clade_90 | Lachnospiraceae_bacterium_4_1_37FAA |
| clade_90 | Lachnospiraceae_bacterium_5_1_57FAA |
| clade_90 | Lachnospiraceae_bacterium_9_1_43BFAA |

TABLE 3

| Genus | Species | BSH activity | | | | | | | |
|---|---|---|---|---|---|---|---|---|---|
| | | gCA | tCA | gCDCA | tCDCA | t-aMCA | t-bMCA | gHCA | tHCA |
| Alistipes | finegoldii | − | +/− | + | + | + | + | + | + |
| Bacteroides | uniformis | − | + | + | + | + | + | | |
| Bacteroides | vulgatus | − | + | + | + | + | + | | |
| Bacteroides | sp_3_1_19 | − | + | + | + | + | + | | + |
| Bacteroides | intestinalis | − | + | + | + | + | + | + | + |
| Bacteroides | sp_20_3 | − | + | + | + | + | + | + | − |
| Bacteroides | intestinalis | − | +/− | + | + | + | + | + | + |
| Bacteroides | caccae | − | − | − | − | + | + | + | + |
| Barnesiella | intestinihominis | − | + | + | + | + | + | | |
| Citrobacter | youngae | − | − | − | − | − | − | − | − |
| Citrobacter | youngae | − | − | − | − | − | − | − | − |
| Clostridiales | sp_SM4_1 | − | +/− | − | +/− | +/− | − | − | +/− |
| Clostridium | lavalense | − | +/− | − | + | + | + | +/− | − |
| Clostridium | innocuum | − | +/− | − | + | + | − | +/− | − |
| Clostridium | sp_NML_04A032 | − | − | − | − | − | − | − | − |
| Clostridium | asparagiforme | − | +/− | − | + | + | + | +/− | − |
| Clostridium | spiroforme | − | +/− | − | +/− | +/− | − | − | − |
| Clostridium | sp_NML_04A032 | − | − | − | − | − | − | − | − |
| Coprococcus | comes | − | − | +/− | − | − | − | − | +/− |
| Eggerthella | sp_1_3_56FAA | − | − | − | − | − | − | − | − |
| Erysipelotrichaceae | bacterium_3_1_53 | − | − | − | − | − | − | − | − |
| Eubacterium | dolichum | − | − | − | − | − | − | − | − |
| Eubacterium | sp_3_1_31 | − | +/− | − | +/− | − | − | − | − |
| Lachnospiraceae | bacterium_6_1_63FAA | − | − | − | − | − | − | − | − |
| Lachnospiraceae | bacterium_3_1_57FAA | − | − | − | − | − | − | − | − |
| Lactobacillus | fermentum | − | − | − | − | − | − | − | − |
| Ruminococcus | bromii | − | − | − | − | − | − | − | − |
| Tannerella | sp_6_1_58FAA | − | + | +/− | + | + | + | + | − |
| Clostridium | sp_HGF2_NCBI_AENW01000022 | − | − | − | − | − | − | − | − |
| Clostridium | hylemonae | − | − | − | − | − | − | − | − |
| Clostridium | hylemonae | − | − | − | − | − | − | − | − |
| Bacteroides | faecis | + | + | + | + | + | + | + | + |
| Bacteroides | sp_3_1_23 | + | + | + | + | + | + | | |
| Bacteroides | sp_D20 | + | + | + | + | + | + | | |
| Bacteroides | eggerthii | + | + | + | + | + | + | | |
| Bifidobacterium | Pseudocatenulatum | + | + | + | + | + | + | | |

TABLE 3-continued

| | | | | | | | | | |
|---|---|---|---|---|---|---|---|---|---|
| Blautia | schinkii | + | + | + | + | | | + | + |
| Blautia | wexlerae | + | + | + | + | + | + | | |
| Blautia | sp_M25 | + | + | + | + | + | + | + | + |
| Clostridium | sordellii | + | + | + | + | + | + | | |
| Clostridium | sp_YIT_12069 | + | + | + | + | | | | |
| Clostridium | paraputrificum | + | + | + | + | + | + | + | + |
| Clostridium | glycolicum | + | + | + | + | + | + | | |
| Clostridium | paraputrificum | + | + | + | + | +/− | − | + | + |
| Collinsella | aerofaciens | + | + | + | + | + | + | | |
| Coprobacillus | sp_D7 | + | − | + | +/− | − | +/− | − | − |
| Coprococcus | comes | + | + | + | + | + | + | + | + |
| Coprococcus | eutactus | + | + | + | + | + | + | + | + |
| Dorea | longicatena | + | + | + | + | + | + | + | + |
| Dorea | Formicigenerans | + | − | + | − | − | − | | |
| Eubacterium | sp_WAL_14571 | + | + | + | + | + | + | + | + |
| Eubacterium | limosum | + | + | + | + | + | + | | |
| Eubacterium | hallii | + | + | − | + | + | + | | |
| Eubacterium | rectale | + | + | + | + | + | + | | |
| Lachnospiraceae | bacterium_2_1_58FAA | + | + | + | + | + | + | + | − |
| Lachnospiraceae | bacterium_9_1_43BFAA | + | + | + | + | | | + | + |
| Lachnospiraceae | bacterium_3_1_57FAA | + | + | + | + | | | + | + |
| Lactobacillus | acidophilus | + | + | + | + | + | + | + | + |
| Lactobacillus | acidophilus | + | + | + | + | + | + | + | + |
| Lactobacillus | gasseri | + | + | + | + | + | + | + | + |
| Parabacteroides | distasonis | + | + | + | + | + | +/− | | |
| Pseudoflavonifractor | capillosus | + | + | + | + | + | + | | |
| Ruminococcus | lactaris | + | + | + | + | + | + | | |
| Ruminococcus | obeum | + | + | + | + | + | + | + | − |
| Eubacterium | rectale | + | + | + | + | + | + | + | + |
| Lachnospiraceae | bacrerium_3_1_57FAA_CT1 | + | + | + | + | + | + | + | + |
| Clostridium | ghonii | + | + | + | + | + | + | + | + |
| Ruminococcus | lactaris | + | + | + | + | − | − | − | − |
| Blautia | producta | + | + | + | + | | | + | + |
| Clostridium | lactifermentans | + | + | + | + | | | + | + |
| Clostridium | viride | + | + | | | + | + | | |
| Dorea | longicatena | + | + | + | + | + | + | | |
| Clostridium | sp_HGF2 | +/− | +/− | + | +/− | +/− | − | +/− | +/− |
| Clostridium | symbiosum | +/− | − | + | +/− | − | − | − | + |
| Dorea | Formicigenerans | +/− | − | +/− | − | − | − | | |
| Gemmiger | formicillis | +/− | + | + | + | + | + | + | − |
| Blautia | schinkii | | | | | | | | |
| Blautia | producta | | | | | | | | |
| Blautia | sp_M25 | | | | | | | | |
| Blautia | producta | | | | | | | | |
| Blautia | glucerasei | | | | | | | | |
| Blautia | producta | | | | | | | | |
| Blautia | coccoides | | | | | | | | |
| Citrobacter | youngae | | | | | | | | |
| Clostridium | scindens | | | | | | | | |
| Clostridium | scindens | | | | | | | | |
| Clostridium | scindens | | | | | | | | |
| Clostridium | disporicum | | | | | | | | |
| Clostridium | butyricum | | | | | | | | |
| Clostridium | orbiscindens | | | | | | | | |
| Clostridium | bolteae | | | | | | | | |
| Clostridium | sp_7_2_43FAA | | | | | | | | |
| Coprococcus | comes | | | | | | | | |
| Eubacterium | rectale | | | | | | | | |
| Eubacterium | rectale | | | | | | | | |
| Eubacterium | contortum | | | | | | | | |
| Lachnospiraceae | bacterium_5_1_57FAA | | | | | | | | |
| Lachnospiraceae | bacterium_5_1_57FAA | | | | | | | | |
| Lachnospiraceae | bacterium_5_1_57FAA | | | | | | | | |
| Lachnospiraceae | bacterium_5_1_57FAA | | | | | | | | |
| Roseburia | faecis | | | | | | | | |
| Roseburia | intestinalis | | | | | | | | |
| Ruminococcus | sp_5_1_39BFAA | | | | | | | | |
| Ruminococcus | bromii | | | | | | | | |
| Ruminococcus | hansenii | | | | | | | | |
| Clostridium | hylemonae | | | | | | | | |
| Lachnospiraceae | bacterium_5_1_57FAA | | | | | | | | |
| Lachnospiraceae | bacterium_5_1_57FAA | | | | | | | | |
| Lachnospiraceae | bacterium_oral_taxon_F15 | | | | | | | | |
| Clostridium | scindens | | | | | | | | |

TABLE 3-continued

| | |
|---|---|
| Lachnospiraceae | bacterium_5_1_57FAA |
| Lachnospiraceae | bacterium_5_1_57FAA |
| Lachnospiraceae | bacterium_5_1_57FAA |
| Dorea | longicatena |
| Clostridium | hylemonae |
| Lachnospiraceae | bacterium_5_1_57FAA |

| | | 7a-HSDH activity | | 3a-HSDH activity | | 12a-HSDH activity | | 7a-Dehydroxylation | |
|---|---|---|---|---|---|---|---|---|---|
| Genus | Species | CA | CDCA | CDCA | LCA | CA | DCA | CA | CDCA |
| *Alistipes* | *finegoldii* | − | − | − | − | − | − | − | − |
| *Bacteroides* | *uniformis* | − | − | − | − | − | − | − | − |
| *Bacteroides* | *vulgatus* | − | − | − | − | − | − | − | − |
| *Bacteroides* | *sp_3_1_19* | | | | | | | | |
| *Bacteroides* | *intestinalis* | | | | | | | | |
| *Bacteroides* | *sp_20_3* | | | | | | | | |
| *Bacteroides* | *intestinalis* | | | | | | | | |
| *Bacteroides* | *caccae* | | | | | | | | |
| *Barnesiella* | *intestinihominis* | | | | | | | | |
| *Citrobacter* | *youngae* | − | − | − | − | − | − | − | − |
| *Citrobacter* | *youngae* | − | − | − | − | − | − | − | − |
| *Clostridiales* | *sp_SM4_1* | | | | | | | | |
| *Clostridium* | *lavalense* | + | − | − | − | − | + | − | − |
| *Clostridium* | *innocuum* | − | − | − | − | − | − | − | − |
| *Clostridium* | *sp_NML_04A032* | − | − | − | − | − | − | − | − |
| *Clostridium* | *asparagiforme* | + | − | +/− | − | − | + | − | − |
| *Clostridium* | *spiroforme* | | | | | | | | |
| *Clostridium* | *sp_NML_04A032* | | | | | | | | |
| *Coprococcus* | *comes* | + | − | − | − | − | + | − | − |
| *Eggerthella* | *sp_1_3_56FAA* | | | | | | | | |
| Erysipelotrichaceae | *bacterium_3_1_53* | + | + | − | − | − | − | − | − |
| *Eubacterium* | *dolichum* | − | − | − | − | − | − | − | − |
| *Eubacterium* | *sp_3_1_31* | − | − | + | + | − | + | − | − |
| Lachnospiraceae | *bacterium_6_1_63FAA* | | | | | | | | |
| Lachnospiraceae | *bacterium_3_1_57FAA* | | | | | | | | |
| *Lactobacillus* | *fermentum* | | | | | | | | |
| *Ruminococcus* | *bromii* | − | − | +/− | − | − | − | − | − |
| *Tannerella* | *sp_6_1_58FAA* | | | | | | | | |
| *Clostridium* | *sp_HGF2_NCBI_AENW01000022* | | | | | | | | |
| *Clostridium* | *hylemonae* | + | − | + | − | + | + | + | +/− |
| *Clostridium* | *hylemonae* | +/− | − | + | − | − | + | + | − |
| *Bacteroides* | *faecis* | | | | | | | | |
| *Bacteroides* | *sp_3_1_23* | + | + | − | − | − | − | − | − |
| *Bacteroides* | *sp_D20* | − | − | − | − | − | − | − | − |
| *Bacteroides* | *eggerthii* | − | − | − | − | − | − | − | − |
| *Bifidobacterium* | *Pseudocatenulatum* | − | − | − | − | − | − | − | − |
| *Blautia* | *schinkii* | | | | | | | | |
| *Blautia* | *wexlerae* | − | − | − | − | − | − | − | − |
| *Blautia* | *sp_M25* | | | | | | | | |
| *Clostridium* | *sordellii* | − | − | +/− | − | − | − | − | − |
| *Clostridium* | *sp_YIT_12069* | | | | | | | | |
| *Clostridium* | *paraputrificum* | | | | | | | | |
| *Clostridium* | *glycolicum* | | | | | | | | |
| *Clostridium* | *paraputrificum* | | | | | | | | |
| *Collinsella* | *aerofaciens* | + | − | + | + | − | + | − | − |
| *Coprobacillus* | *sp_D7* | | | | | | | | |
| *Coprococcus* | *comes* | + | − | − | − | − | + | − | − |
| *Coprococcus* | *eutactus* | + | − | +/− | − | − | + | − | − |
| *Dorea* | *longicatena* | − | − | − | − | − | − | +/− | − |
| *Dorea* | *Formicigenerans* | | | | | | | | |
| *Eubacterium* | *sp_WAL_14571* | | | | | | | | |
| *Eubacterium* | *limosum* | + | + | − | − | − | + | − | − |
| *Eubacterium* | *hallii* | + | − | − | − | − | + | − | − |
| *Eubacterium* | *rectale* | − | − | − | − | − | − | − | − |
| Lachnospiraceae | *bacterium_2_1_58FAA* | − | − | + | + | − | − | − | − |
| Lachnospiraceae | *bacterium_9_1_43BFAA* | | | | | | | | |
| Lachnospiraceae | *bacterium_3_1_57FAA* | | | | | | | | |
| *Lactobacillus* | *acidophilus* | | | | | | | | |
| *Lactobacillus* | *acidophilus* | | | | | | | | |
| *Lactobacillus* | *gasseri* | | | | | | | | |
| *Parabacteroides* | *distasonis* | − | − | − | − | − | − | − | − |
| *Pseudoflavonifractor* | *capillosus* | − | − | + | +/− | − | − | − | − |
| *Ruminococcus* | *lactaris* | − | − | − | − | − | − | − | − |
| *Ruminococcus* | *obeum* | | | | | | | | |
| *Eubacterium* | *rectale* | − | − | +/− | − | − | − | − | − |
| Lachnospiraceae | *bacrerium_3_1_57FAA_CT1* | | | | | | | | |
| *Clostridium* | *ghonii* | +/− | + | + | − | − | − | +/− | − |
| *Ruminococcus* | *lactaris* | + | − | − | − | − | − | +/− | − |

TABLE 3-continued

| | | | | | | | | | |
|---|---|---|---|---|---|---|---|---|---|
| Blautia | producta | − | − | − | | − | +/− | +/− | − |
| Clostridium | lactifermentans | − | + | + | | − | − | +/− | − |
| Clostridium | viride | − | + | − | | − | +/− | +/− | − |
| Dorea | longicatena | − | − | − | − | − | − | +/− | − |
| Clostridium | sp_HGF2 | − | − | − | | − | − | − | − |
| Clostridium | symbiosum | + | + | +/− | | − | − | − | − |
| Dorea | Formicigenerans | | | | | | | | |
| Gemmiger | formicillis | − | − | − | | − | − | − | − |
| Blautia | schinkii | − | + | − | | − | − | − | − |
| Blautia | producta | − | − | − | | − | − | − | − |
| Blautia | sp_M25 | − | − | +/− | | − | − | − | − |
| Blautia | producta | | | | | | | | |
| Blautia | glucerasei | | | | | | | | |
| Blautia | producta | | | | | | | | |
| Blautia | coccoides | | | | | | | | |
| Citrobacter | youngae | − | + | + | + | + | + | + | + |
| Clostridium | scindens | + | + | + | + | + | + | + | + |
| Clostridium | scindens | − | + | + | − | − | + | + | + |
| Clostridium | scindens | − | + | + | − | − | + | + | + |
| Clostridium | disporicum | − | + | − | | − | − | − | − |
| Clostridium | butyricum | − | + | − | | − | − | − | − |
| Clostridium | orbiscindens | − | + | − | − | − | + | − | − |
| Clostridium | bolteae | − | − | + | +/− | − | − | − | − |
| Clostridium | sp_7_2_43FAA | + | + | +/− | | − | − | − | − |
| Coprococcus | comes | − | − | − | | − | − | − | − |
| Eubacterium | rectale | − | − | − | | − | − | − | − |
| Eubacterium | rectale | − | − | − | | − | − | − | − |
| Eubacterium | contortum | − | − | +/− | | − | − | − | − |
| Lachnospiraceae | bacterium_5_1_57FAA | +/− | +/− | + | + | +/− | | + | + |
| Lachnospiraceae | bacterium_5_1_57FAA | − | +/− | + | + | − | + | + | + |
| Lachnospiraceae | bacterium_5_1_57FAA | − | +/− | + | + | − | + | + | + |
| Lachnospiraceae | bacterium_5_1_57FAA | − | +/− | + | + | − | + | + | + |
| Roseburia | faecis | − | − | +/− | | − | − | − | − |
| Roseburia | intestinalis | − | − | − | | − | − | − | − |
| Ruminococcus | sp_5_1_39BFAA | − | − | − | | − | − | − | − |
| Ruminococcus | bromii | − | − | − | | − | − | − | − |
| Ruminococcus | hansenii | − | − | − | | − | − | − | − |
| Clostridium | hylemonae | +/− | − | + | − | | + | + | + |
| Lachnospiraceae | bacterium_5_1_57FAA | − | + | + | + | − | − | + | + |
| Lachnospiraceae | bacterium_5_1_57FAA | − | + | + | + | − | − | + | + |
| Lachnospiraceae | bacterium_oral_taxon_F15 | − | + | + | | − | +/− | +/− | − |
| Clostridium | scindens | + | + | +/− | − | +/− | + | + | + |
| Lachnospiraceae | bacterium_5_1_57FAA | + | + | + | − | + | − | + | + |
| Lachnospiraceae | bacterium_5_1_57FAA | − | − | + | + | − | − | + | + |
| Lachnospiraceae | bacterium_5_1_57FAA | − | − | + | + | − | − | + | + |
| Dorea | longicatena | − | − | − | | − | − | − | − |
| Clostridium | hylemonae | +/− | − | − | | − | − | − | − |
| Lachnospiraceae | bacterium_5_1_57FAA | + | + | − | | − | − | − | − |

In some embodiments, all organisms in a composition are obligate anaerobes. In some embodiments, the bacteria in a composition are species that can be cultured in vitro to form spores and such spores can be germinated in vitro. In some embodiments, the bacteria in a composition are spores. In some embodiments, the bacteria in a composition are in vegetative form. It is to be understood that a composition of bacterial spores or a composition of vegetative bacteria means that while the majority of bacteria are in the specified form (i.e., spore or vegetative), a small number may be in a different form, e.g., in the case of spores, some cells in a composition may be vegetative, while in the case of vegetative bacteria, some cells may be in the form of spores. For example, the composition may be 100%, at least 99%, at least 97%, at least 95%, at least 90%, at least 85%, at least 80%, or at least 75% spores, or the composition may be 100%, at least 99%, at least 97%, at least 95%, at least 90%, at least 85%, at least 80%, or at least 75% vegetative bacteria. In some embodiments, the individual species are present as a mixture of vegetative bacteria and spores. In some embodiments, the number of a species used in a composition is determined using colony-forming unit (cfu) assay, although other methods known in the art can be used. The assessment of percent of bacteria in a vegetative or spore specific form may be referenced as of the date of preparing the composition in a dosage form or as of the date or administration of the dosage form. Methods of preparing spores are described in the art, e.g., U.S. Pat. No. 9,011,834.

The total number of bacteria effective in a treatment is far below the total number of organisms in the gastrointestinal tract of a healthy human, i.e., it is not necessary to administer a complete healthy microbiome to achieve a therapeutic effect, not only in terms of the diversity of the species provided in a composition, but also in the total number of organisms provided.

It is to be understood that if a composition is indicated as "consisting of" particular types of bacteria in this application, this refers only to the bacteria types that are present in a composition. A bacterial formulation that "consists of" a particular list of bacteria may contain additional non-bacterial materials such as one or more excipients (including, for example, one or more capsules), an aqueous or non-aqueous medium (for example, glycerol, polyethylene glycol, cocoa butter, water, and/or buffer), as well as one or more prebiotics or small molecule drugs.

Determination of Identity

Clades, operational taxonomic units (OTUs), species, and strains are, in some embodiments, identified by 16S rDNA sequence(s). The relatedness of clades, OTUs, species, and strains can be determined by the percent identity between clades, OTUs, species, or strains. In some cases, the percent identity is determined using a 16S rDNA sequence. The 16S rDNA sequence can be full-length, one or more variable regions and be from a single sequence or a composite derived from multiple 16S rDNA sequences from a strain, species, or OTU. Percent identity between a reference and query sequence can be determined using methods known in the art. Non-limiting examples of methods for such determinations are provided below. As used herein, the relatedness between two nucleotide sequences is described by the parameter "identity." In general, a two bacteria are the same OTU or species if they have 16S rDNA identity of at least 95%, e.g., 97%, 98%, 99%, or 100%. In some embodiments, the 16S rDNA identity is determined for the full length 16S rDNA molecule. In some embodiments, the 16S rDNA identity is determined fora fragment of a 16S rDNA molecule, such as a variable region (e.g., V4). In some embodiments, the identity is determined for a fragment of, e.g., at least 10, 15, 20, 25, 30, 35, 40, 45, 50, 60, 75, 100, 125, 150, 175, 200, 225, 250, 300, or more nucleotides in length (or in ranges between any of the numbers listed herein; or in specific values in such ranges).

In one embodiment, the degree of sequence identity between a query sequence and a reference sequence is determined by 1) aligning the two sequences by any suitable alignment program using the default scoring matrix and default gap penalty, 2) identifying the number of exact matches, where an exact match is where the alignment program has identified an identical nucleotide in the two aligned sequences on a given position in the alignment and 3) dividing the number of exact matches with the length of the reference sequence.

In another embodiment, the degree of sequence identity between a query sequence and a reference sequence is determined by 1) aligning the two sequences by any suitable alignment program using the default scoring matrix and default gap penalty, 2) identifying the number of exact matches, where an exact match is where the alignment program has identified an identical nucleotide in the two aligned sequences on a given position in the alignment and 3) dividing the number of exact matches with the length of the longest of the two sequences.

In another embodiment, the degree of sequence identity between the query sequence and the reference sequence is determined by 1) aligning the two sequences by any suitable alignment program using the default scoring matrix and default gap penalty, 2) identifying the number of exact matches, where an exact match is where the alignment program has identified an identical amino acid or nucleotide in the two aligned sequences on a given position in the alignment and 3) dividing the number of exact matches with the "alignment length," where the alignment length is the length of the entire alignment including gaps and overhanging parts of the sequences.

Sequence identity comparisons are, generally, with the aid of a sequence comparison program. These commercially or publicly available computer programs use complex comparison algorithms to align two or more sequences that best reflect the evolutionary events that might have led to the difference(s) between the two or more sequences. Therefore, these algorithms operate with a scoring system rewarding alignment of identical or similar amino acids and penalizing the insertion of gaps, gap extensions and alignment of non-similar amino acids. The scoring system of the comparison algorithms include:

i) assignment of a penalty score each time a gap is inserted (gap penalty score), ii) assignment of a penalty score each time an existing gap is extended with an extra position (extension penalty score), iii) assignment of high scores upon alignment of identical amino acids, and iv) assignment of variable scores upon alignment of non-identical amino acids.

In general, the default values of the alignment program are used for sequence comparisons.

Suitable computer programs useful for determining identity include, for example, BLAST (blast.ncbi.nlm.nih.gov).

In an embodiment of the present invention, the alignment program optimizes the alignment over the full-length of selected sequences, e.g., full-length, V1-3, V4, or V6 16S rDNA sequence. A 16S rDNA sequence can be a single sequence or a composite of multiple 16S rDNA sequences from a selected strain, species, or OTU. For example, the global alignment program is based on the Needleman-Wunsch algorithm (Needleman and Wunsch, J. Mol. Biol. 48:443-453, 1970). Non-limiting examples of such programs are EMBOSS Needle and EMBOSS Stretcher programs, available at ebi.ac.uk/Tools/psa/.

In one embodiment, the sequences are aligned by a global alignment program and the sequence identity is calculated by identifying the number of exact matches identified by the program divided by the "alignment length," where the alignment length is the length of the entire alignment including gaps and overhanging parts of the sequences. In a further embodiment, the global alignment program uses the Needleman-Wunsch algorithm and the sequence identity is calculated by identifying the number of exact matches identified by the program divided by the "alignment length," where the alignment length is the length of the entire alignment including gaps and overhanging parts of the sequences.

In yet a further embodiment, the global alignment program is selected from the group consisting of EMBOSS Needle and EMBOSS stretcher and the sequence identity is calculated by identifying the number of exact matches identified by the program divided by the "alignment length," where the alignment length is the length of the entire alignment including gaps and overhanging parts of the sequences.

Once the software has produced an alignment, it is possible to calculate percent (%) similarity and percent sequence identity.

Formulations

In some embodiments, treatment includes administering a composition to a subject, for example, a patient at risk for, recently treated for, or that has been diagnosed with a cholestatic disease or condition. In some embodiments, the composition is an oral dosage form. In some embodiments, the composition comprises, as the active component a consortium of bacteria as described herein in combination with one or more pharmaceutically acceptable carriers (excipients). In making the compositions of the invention, the bacteria are typically mixed with an excipient, diluted by an excipient or enclosed within such a carrier in the form of, for example, a capsule, sachet, paper, or other container. When the excipient serves as a diluent, it can be a solid, semi-solid, or liquid material, which acts as a vehicle, carrier or medium for the active component. Thus, a formulation can be in the form of a tablet, pill, powder, lozenge, sachet, cachet, elixir, suspension, emulsion, solution, syrup, aerosol (as a solid or in a liquid medium), ointment containing, for example, up to 10% by weight of the active component, soft capsule, hard capsule, gel-cap, tablet, suppository, solution, or packaged powder. Suitable excipients include, for example, PBS, glycerol, cocoa butter, or polyethylene glycol.

In preparing a formulation, a solid form of the composition can be milled to provide the appropriate particle size prior to combining with the other ingredients. Moreover, the compositions can be formulated so as to provide quick, sustained or delayed release of the active component after administration to the patient, for example, for release in the colon, by employing methods and forms known in the art.

A composition can be formulated in a unit dosage form, each dosage form containing from about $10^2$ to about $10^9$ viable OTUs, for example, about $10^4$ to about $10^8$ OTUs. In some embodiments, substantially all of the bacteria are in spore form. In some embodiments, the bacteria are in spore and vegetative form. The term "unit dosage forms" refers to physically discrete units suitable as unitary dosages for human subjects and other mammals, each unit containing a predetermined quantity of active component calculated to produce the desired therapeutic effect, in association with a suitable pharmaceutical excipient. In some cases, more than one unit dosage form constitutes a dose. For example, a single dose can be one unit dosage form, two dosage unit forms, three dosage unit forms, four unit dosage forms, five unit dosage forms or more. In some cases, the number of unit dosage forms constituting a single dose is 1, 2, 3, 4, 5, 6, 7, 8, 9, 10, 11, 12, 13, 14, 15, 20, 25, or 30 unit dosage forms. A single dose can be, e.g., $10^3$ to about $10^9$ spores, for example, about $10^4$ to about $10^8$ spores. In an example, a dose is 1, 2, 3, or 4 capsules containing a total of between $10^2$ and $10^8$ spores in the dose. In the case of a single dose having multiple dosage forms, the dosage forms are generally delivered within a prescribed period, e.g., within 1 hour, 2 hours, 5 hours, 10 hours, 15 hours, or 24 hours.

A composition described herein can be effective over a wide dosage range and is generally administered in a pharmaceutically effective amount.

A tablet or pill comprising a composition described herein can be coated or otherwise compounded to provide a dosage form, for example, to ease delivery (for example, by improving swallowability) or to improve delivery to a targeted area of the gastrointestinal tract such as the colon.

In some embodiments, the tablet or pill comprises an inner component surrounding the composition and an outer component, the latter serving as an envelope over the former. The two components can be separated by an enteric coating layer that may resist disintegration in the stomach and permits the inner component to pass intact into the duodenum or to be delayed in release.

In some embodiments, a formulation comprising a composition of the invention is administered via a nasogastric route, by endoscopy or other suitable method of delivering the formulation at or near a desired site, for example, the upper intestinal tract (e.g., stomach and/or duodenum) or the lower intestinal tract (e.g., small intestine and/or large intestine). Effective doses can be extrapolated from dose-response curves derived from in vitro or animal model test systems or from clinical studies.

Furthermore, the formulations can optionally be administered in combination with antacids that are known in the art.

Methods of Treatment

Compositions as described herein are useful for administration to a subject, e.g., a mammal such as a human in need of treatment, e.g., to prevent or treat a cholestatic disease or condition. Examples of such diseases include general cholestasis (GC), primary sclerosing cholangitis (PSC), primary biliary cholangitis (PBS), progressive familial intrahepatic cholestasis (PFIC), non-alcoholic fatty liver disease (NAFLD), non-alcoholic steatohepatitis (NASH), cholestasis of pregnancy, cholangitis, hepatitis, alcoholic liver disease, hepatocellular carcinoma, liver cirrhosis, cystic fibrosis, and graft-versus-host disease (GVHD). In addition, subjects having a blockage of an extrahepatic bile duct due to, e.g., gall stone, inflammatory stricture, cancer, or pancreatitis, can be treated by the methods of the invention. For example, a Max BA activity composition that can provide BSH, 7α-dehydroxylation, and hydroxysteroid dehydrogenation activities (elevated activity compared to a reference having low activity), can be used to treat cholestatic disease patients that show abnormal bile acid composition, e.g., an abnormal accumulation of conjugated primary bile acids.

In some embodiments, patients responding to OCA and/or UDCA treatment, but experiencing undesirable side-effects (e.g., severe (intolerable) pruritus, elevations in liver-related adverse reactions and/or biochemical tests associated with OCA treatment, or an undesirable reduction in HDL-C) can be treated with a BSH only composition, or other composition described herein having at least a BSH activity, thereby permitting a reduction in the amount or frequency of administration of the OCA and/or UDCA; or increasing the patient's tolerance of a normal or elevated dose of OCA and/or UDCA. Without committing to any particular theory, it may be that by altering levels of bile acids in such patients, primary and/or secondary bile acids such as CDCA synergize with OCA or UDCA, improving patient treatment of a liver disease such as PBC.

The methods and compositions of the invention can be used to improve one or more symptoms of these diseases and conditions by improving bile acid metabolism. While the methods may not necessarily address the causal pathologies of cholestatic diseases, depleting the source of bile duct injury, both by reducing total bile acid pools and conversion of conjugated primary bile salts into primary bile acids and/or to secondary bile acids, can have a significant impact on the progression of disease and patient well-being, including in the absence of significant alternative approaches. Advantages of this approach can include treatment of otherwise intractable disease, treatment with fewer undesirable side effects compared to presently available treatments, or a decrease in undesirable side effects associated with presently available treatments, e.g., by decreasing the effective dose of an available treatment. Unless indicated otherwise, the term "total bile acids" as used herein means the sum of the dominant bile acids detected in an animal. In humans, this typically refers to at least cholic acid, glycocholic acid, deoxycholic acid, taurocholic acid, chenodeoxycholic acid, glycochenodeoxycholic acid, taurochenodeoxycholic acid, ursodeoxycholic acid, and lithocholic acid. In some embodiments, this also includes α-muricholic acid, beta-muricholic acid, gamma-muricholic acid (hyocholic acid), oxo-bile acids, and iso-bile acids. In some embodiments, the mammalian subject is a human subject who has one or more symptoms of a cholestatic disease or condition. In some embodiments, efficacy of a composition can be assessed by measuring bile acid composition, for example relative levels of selected bile acids compared to each other or concentration of one of more bile acids compared to a reference. Such measures can be made using, for example, fecal or serum bile acid levels. In some embodiments, metabolic indications of treatment can be assayed. In some embodiments, the presence or absence of bacterial species administered in a composition can be assayed. Such measures can also be used to monitor patient therapy, for example, to determine whether a patient requires additional treatment with a composition. Methods of identifying an appropriate reference are known to those in the art and include, for example, levels of one or more bile acids in a healthy patient population, levels of one of more bile acids in an untreated patient population diagnosed with the disease, or an improvement in levels of one or more bile acids in a patient after treatment compared with levels prior to treatment.

In some embodiments, effective treatment decreases alkaline phosphatase (ALP) activity or concentration, e.g., in liver, blood, or serum, compared to ALP activity or concentration in the patient prior to treatment; or decreases concentration or activity compared to a reference. Consistent with FDA labeling of Ocaliva® (obeticholic acid), such a decrease is sufficient to justify treatment even in the case where no statistically significant decrease in symptoms is observed. Methods of assaying ALP are known in the art.

In some embodiments, efficacy of a composition can be assessed by a decrease in bilirubin compared to bilirubin levels prior to treatment. For example, in some embodiments, an effective treatment results in lowering bilirubin levels below 25 milligrams per deciliter in the patient's urine. Bilirubin can also be assayed in blood, for example, total bilirubin is less than 1.0 mg/dL. Methods of assaying bilirubin levels are known in the art.

In some cases, effective treatment with a composition of the invention results in at least one of the following; reduction of alkaline phosphatase levels to <1.67× upper limit of normal (ULN), reduction of total bilirubin to ≤ULN, or alkaline phosphatase reduction by ≤15% from baseline.

The amount and frequency of a therapeutic composition administered to a patient will vary depending upon what is being administered, the purpose of the administration, such as prophylaxis or therapy, the state of the patient, the manner of administration, and the like. In therapeutic applications, compositions can be administered to a patient already suffering from a disease in an amount sufficient to cure or at least partially arrest the symptoms of the disease and its complications. Effective doses will depend on the disease condition being treated as well as by the judgment of the attending clinician depending upon factors such as the severity of the disease, the age, weight, and general condition of the patient, and the like. Reference is made to the dosage information noted above in the section relating to formulations.

In some embodiments, the subject receives an antibiotic treatment prior to administration of the composition. In some embodiments, the subject receives an antibiotic treatment and does not receive the composition until at least one day, two days, three days, 5 days, one week, two weeks, three weeks, or four weeks has elapsed since the antibiotic treatment and prior to administration of the composition. In some embodiments, the subject receives multiple doses of the composition to ensure coverage of the dosing period. In some embodiments, the subject has symptoms of a cholestatic disease prior to administration of the composition. In other embodiments, the subject does not exhibit symptoms of the cholestatic disease prior to administration of the composition, e.g., the composition is administered prophylactically to reduce the risk that a cholestatic disease will result in clinical symptoms.

In some embodiments, a composition is administered only once prior to improvement of the disease, disorder, or condition. In some embodiments, the therapeutic composition is administered at intervals greater than two days, such as once every three, four, five or six days, or every week or less frequently than every week, e.g., every two weeks, every three weeks, every 4 weeks, every six weeks, every eight weeks, every twelve weeks, once per month, once per two months, once per three months, once per four months, or once per six months. In some cases, the composition is administered intermittently according to a set schedule, e.g., once a day, once weekly, or once monthly, or when the subject relapses from the primary illness. In another embodiment, the composition is administered on a long-term basis to individuals who are at risk for cholestatic disease.

In some embodiments, the composition is generally administered enterally. For example, administration can be oral administration via a swallowed form (e.g., a pill, sachet, capsule, syrup or the like), or by an oral or nasal tube (including nasogastric, nasojejunal, oral gastric, or oral jejunal). In other embodiments, administration includes rectal administration (for example, by enema, suppository, or colonoscopy). The composition can be administered to at least one region of the gastrointestinal tract, including the mouth, esophagus, stomach, small intestine, large intestine, or rectum. A composition can be administered or ally in the form of a medicament such as a powder, one or more capsules, one or more tablets, a gel or a liquid. A composition can also be administered in gel or liquid form by the oral route or through a nasogastric tube, or by the rectal route in a gel or liquid form, by enema or instillation through a colonoscope or by a suppository.

The subject may have a colonic-cleansing preparation prior to administration of a composition. Methods of colonic-cleansing are known in the art such as those used to prepare a subject for a colonoscopy. Also, the subject may optionally be treated with an antacid or buffering agent to increase stomach pH at the time of composition administration, as is known in the art and determined to be appropriate for the subject.

Combination Therapy

As discussed above, a composition or formulation of the invention, such as those described herein, can be administered in combination with another agent useful in the treatment or prevention of cholestatic diseases. Thus, for example, the compositions or formulations of the invention can be administered in combination with one or more of the following agents: Ocaliva® (OCA, INT-747), INT-767 (FXR/TGR5 agonist), LJN452, GS-9674 (PX-102), PX-104, EDP-305, EP 024297, WAY-362450 (FXR-450) (XL335), GSK2324, GW4064, Fexaramine, endogenous bile acids (CDCA, LCA/DCA, and/or UDCA). These additional agents can be administered in separate compositions from the compositions or formulations of the invention, or can be combined with them to create additional new compositions. The additional agents can be administered at the same time as the compositions or formulations of the invention or, alternatively, can be administered within 1, 2, 4, 8, 12, 24, or more hours or days of the compositions or formulations of the invention, as determined to be appropriate by one of skill in the art. In one particular example of a combination or formulation of the invention, Ocaliva (OCA) is administered in combination with a composition of the invention that increases CDCA.

Methods of Testing Candidate Compositions

Murine Models

Animal models in which bile acid metabolism is adversely affected can be used to test candidate compositions for their ability to ameliorate a symptom of a cholestatic disease. Using such models, a candidate composition is administered to the model and an improvement of at least one sign or symptom of disease or a reduction in the rate of disease progression indicates the candidate can be used to treat a cholestatic.

One example of such a model is a multidrug resistance 2 knockout (mdr2−/−) mouse. mdr2 is the mouse homolog of human mdr3, a transporter that exports phosphatidylcholine (PC) from the liver into the hepatic canaliculi. The absence of PC is thought to lead to a bile composition that is abnormally high in primary bile salts that are not properly sequestered in micelles. This excess of primary bile salts is thought to cause bile duct damage that underlies cholestasis in these animals. (Smit et al., Cell 75:451-462, 1993; Fickert et al., Gastroenterology 127:261-274, 2004). mdr2−/− knockout mice develop bile duct damage having features similar to those seen in humans diagnosed with primary sclerosing cholangitis (PSC) and other disorders associated with abnormalities in bile acids, in particular, with respect to biliary strictures and liver fibrosis. These mice lack biliary phospholipids, which results in bile duct inflammation and damage due to micelles with an excess of bile acids and that develops into a pathophysiology that mimics primary sclerosing cholangitis.

LaRusso and colleagues report further development of the mdr2−/− model, based on the observation that mice having an mdr2−/− genetic background and raised germ-free (GF) develop a more severe form of the disease than conventionally-housed (CH) mdr2−/− mice (Tabibian et al., Hepatology 2015). In this model, mdr2−/− mice that are raised GF display typical alterations in intestinal tissue associated with the GF state, such as shallower colonic crypts, decreased ileal villous length, and diminished expression of the epithelial tight junction protein, zonula occludens. However, compared to conventionally raised mdr2−/− mice, differences are observed in serum biochemical markers for hepatobiliary disease at 60 days of age, including increases in aspartate aminotransferase, alkaline phosphatase, and bilirubin. Cholangiocyte senescence was assessed by p16INK4a in situ hybridization in liver tissue and was significantly increased in germ-free mice. These biochemical and histochemical markers were further confirmed by histopathology measurements. In addition, analysis of bile acid composition showed the absence of primary or secondary bile acids derived from microbial activity, as would be expected for germ-free mice. Serum biochemistries, including alkaline phosphatase, aspartate aminotransferase, and bilirubin, were all significantly higher in the GF mdr2−/− mouse. Younger GF mdr2−/− mice (30 days of age) also exhibit altered serum biochemical markers indicative of more severe hepatobiliary disease than conventionally raised mdr2−/− cohorts.

A second model of cholestatic disease, developed by Fickert et al. in 2007 (Fickert et al., Am. J. Pathol. 171(2): 525-536, 2007), induces bile duct injury and obstruction using the compound 3,5-diethoxycarbonyl-1,4-dihydrocollidine (DDC) leading to cholangitis and liver fibrosis. In conventional Swiss albino mice, DDC treatment resulted in inflammation, fibrosis, bile duct obstruction and chronic cholangitis, accompanied by symptoms such as elevated alkaline phosphatase and alanine transferase levels such as those seen in PSC patients. Symptoms are visible within a 4-week period making this a rapid model to study cholestatic disease. The role of the microbiome in this chemical model had not, however, been explored, and the effect of microbial bile acid metabolism on the susceptibility of germ-free mice to DDC-diet induced liver disease is elucidated in this patent.

Reportedly, bile acid profiles show no significant differences between GF and CH mdr2−/− mice with respect to primary bile acids (by HPLC). However, total serum bile acid levels were significantly higher in mdr2−/− mice. Similarly, total serum bile acids were elevated in the DDC-diet model of cholestasis, but levels of biliary bile acids were not altered with disease. Germ-free mice are unable to make secondary bile acids due to lack of microbial activity. Thus, germ-free models enable evaluation of various bacterial combinations designed to highlight specific bile acid enzymatic activity, such as deconjugation of primary bile acids or conversion of primary to secondary bile acids. In addition, this screen also enables the assessment of a specific primary or secondary bile acid or combinations of bile acids to identify those that can mediate changes in the disease phenotype in vivo. In some embodiments, a bacterial composition tested in this model or other models described herein alters total levels of primary and secondary bile acids, enabling measurement of the effects of altering bile acid composition on the disease phenotype.

Additional methods of evaluating the efficacy of a composition in a murine PSC/bile acid disease model include histological evaluation of mice after conventionalization with defined microbial compositions compared to germ-free littermates using the methods described by Tabibian et al. (Hepatol. 63:185-196, 2015). Germ-free mdr2−/− reportedly have a significantly higher proportion of advanced liver fibrosis compared to CH mdr2−/− mice and, in some cases, exhibit cirrhosis by 60 days while CH mdr2−/− mice are not reported as developing cirrhosis. Therefore, a reduction in liver fibrosis in a GF mdr2−/− mouse treated with a composition described herein indicates that the composition is useful for treating PSC or other disorder related to bile acid signaling such as NAFLD or NASH. Other methods of evaluating the effect of a candidate composition using GF mdr2−/− mice include detecting a decrease in ductular reaction and ductopenia, and a decrease in the proportion of senescent cholangiocytes in the presence of a composition that is useful for treating PSC or other disorder of bile acid metabolism, and a decrease in liver enzymes, such as ALP, and bilirubin in serum.

Candidate compositions can be tested in the mdr2−/− GF model, or in a germ-free version of the DDC-diet induced cholestatic disease model, as described above. Any other suitable model of an appropriate disorder of bile acid metabolism, for example, as described in the Examples (infra) may also be used. A candidate composition that is useful for treating such a disorder, i.e., a therapeutic composition, is a composition that, when administered for a suitable amount of time, decreases at least one sign or symptom of disease in an animal model of the disorder compared to an animal that did not receive the candidate composition.

Methods of identifying signs and symptoms of disease and improvement thereof are known in the art. For example, bile acid concentrations in serum can be assayed using colorimetric methods (e.g., kit from Trinity Biotech (Jamestown, N.Y.)). Thin layer chromatography, high-performance liquid chromatography (HPLC), gas chromatography, or liquid chromatography in combination with tandem mass spectrometry (GC-MS or LC-MS/MS) can also be used to detect activity of bile acid metabolizing enzymes and changes in the composition of bile acids.

Compositions that prevent or ameliorate at least one sign or symptom associated with the selected bile acid disorder in an animal model of disease are termed "therapeutic compositions" and are useful for treating the disorder.

EQUIVALENTS

All technical features can be individually combined in all possible combinations of such features. The invention may be embodied in other specific forms without departing from the spirit or essential characteristics thereof. The foregoing embodiments are therefore to be considered in all respects illustrative rather than limiting on the invention described herein.

EXAMPLES

The following non-limiting examples further illustrate embodiments of the inventions described herein.

Example 1: Materials and Methods

Materials

Taurocholic acid (t-CA), tau rochenodeoxycholic acid (t-CDCA), glycocholic acid (gCA), glycochenodeoxycholic acid (gCDCA), cholic acid (CA), chenodeoxycholic acid (CDCA), deoxycholic acid (DCA), lithocholic acid (LCA), and 3,5-diethoxycarbonyl-1,4-dihydrocollidine (DDC) were obtained from Sigma-Aldrich (St. Louis, Mo.). Beta-muricholic acid (bMCA), 7-oxocholic acid, 7-oxochenodeoxycholic acid, and tauro-beta-muricholic acid (t-MCA) were obtained from Santa Cruz Biotechnology (Dallas, Tex.). Alpha-muricholic acid (aMCA), tauro-alpha-muricholic acid (t-MCA), 12-oxocholic acid, 12-oxodeoxycholic acid, 3-isodeoxycholic acid (3β 12α), hyodeoxycholic acid (3α 6α), hyocholic acid (HCA), and 3-oxodeoxycholic acid were obtained from Steraloids (Newport, R.I.). Bile acid stocks used in LC-MS based enzymatic assays were prepared by dissolving compounds in ethanol. Chenodeoxycholic acid (CDCA; Sigma-Aldrich) and obeticholic acid (OCA; MedChemExpress, NJ) used for cell-based assays were dissolved in DMSO to make a stock.

Colonization

Germ-free and conventional mice were purchased from Taconic Biosciences (Hudson, N.Y.) and used between 6-10 weeks of age, inclusive. Germ-free mice were dosed with 100 μL of 7.5% sodium bicarbonate via oral gavage to neutralize GI tract acids and improve survivability of administered bacteria. Approximately 10-30 minutes after receiving sodium bicarbonate, mice were dosed with 200 μL of a specific bacterial composition via oral gavage. Mice were handled in an aseptic manner, housed in germ-free isolators, and provided sterile chow and water. All studies were approved by individual Institute of Animal Care and Use Committees for each study site.

Fecal Collections

Immediately prior to dosing, fresh fecal pellets were collected directly from mice and then at 1 day, 3 days, 7 days, or weekly post-dosing. At each time point, two fecal pellets were collected into sterile 1.7 mL microfuge tubes. One fecal pellet was frozen at −80° C. to hold for analysis by LC-MS. The second fecal pellet was homogenized into 100 μL of 15% glycerol in PBS (v/v) and then frozen at −80° C. to hold for microbiological and sequence analysis.

Sequence Analysis

Sequences were analyzed using 16S rDNA V4 sequences using Next-Generation sequencing (NGS; high throughput sequencing) and mapped to identify the closest corresponding OTU. Sequence identity was at least 97% (to the nearest 0.1%) for all species calls. An internal proprietary manually curated reference OTU database was used for assign species identities.

Assay for Bile Salt Hydrolase (BSH) Activity

Bacterial whole cell suspensions in PBS were incubated with mixtures of conjugated bile acids, each at a final concentration of 150 μg/ml. Reaction mixtures in 96-well plates were incubated for 4 hours at 37° C. under anaerobic conditions. After incubation, samples were removed from the anaerobic chamber. An equal volume of acetonitrile was added to samples to extract bile acids, plates were centrifuged to pellet bacteria, and the resulting supernatant filtered through a 0.2 μm filter, generating a sample for LC-MS analysis.

Assays for Hydroxysteroid Dehydrogenase and 7α-Dehydroxylation Activities

To assay hydroxysteroid dehydrogenase (HSDH) and 7α-dehydroxylation activity, bacterial suspensions in brain-heart infusion (BHI) medium were incubated with cholic acid or chenodeoxycholic acid individually, each at a concentration of 100 μM, for 4 hours at 37° C. in an anaerobic chamber. After incubation, samples were removed from the anaerobic chamber. An equal volume of acetonitrile was added to samples to extract bile acids, plates were centrifuged to pellet bacteria, and the resulting supernatant filtered through a 0.2 μm filter, generating a sample for LC-MS analysis.

Designed Compositions

A collection of research cell banks (RCBs) was used to create designed compositions (DE) for in vivo studies. The vegetative titer of each cell bank (CFU/mL) was used to calculate the volumes of each needed to create a designed composition with a final titer 1.00E+07 CFU/strain for each dose. Volume of an individual RCB to be added to the designed composition was calculated as follows:

[total vegetative titer needed for all doses (e.g., for 10 doses at 1.00$E$+07=1.00$E$+08 CFU total)]/ [RCB vegetative titer in CFU/mL]=volume needed for 1.00$E$+07 CFU/dose for 10 doses This was repeated for each RCB in the defined DE to determine volumes, after which the calculated volume of each RCB was combined in an anaerobic chamber to formulate the RCB, vortexed, spun down, and resuspended in a final volume of 15% glycerol-PBS.

Extraction of Bile Acids from Mouse Fecal and Liver Samples

Mouse fecal pellets were weighed, homogenized in 10×w/v extraction buffer (50% methanol in water), and extracted on ice for 1 hour. Liver tissue samples were similarly weighed, homogenized in 2×w/v extraction buffer (50% methanol in water), and extracted on ice for 1 hour. Post incubation, samples were further extracted with an equal volume of cold acetonitrile, centrifuged, and the supernatant filtered through a 0.22 μm filter prior to loading on an LC-MS for analysis.

Extraction of Bile Acids from Portal, Serum and Bile Samples

Peripheral serum samples were diluted 1:1 in acetonitrile, centrifuged, and the supernatant filtered through a 0.22 μm filter prior to loading on an LC-MS for analysis. Portal serum samples were diluted 1:10 in acetonitrile and similarly centrifuged and filtered prior to LC-MS analysis. Finally, bile samples were diluted 1:100 in acetonitrile, centrifuged, and filtered through a 0.22 μm filter for LC-MS analysis. The same procedures were utilized for both human and mouse samples.

LC-MS Analysis of Bile Acids

Bile acids were separated using an Agilent 1260 HPLC equipped with a Microsolv bidentate C18 column preceded by a 0.2 μm pre-column filter. Separation was achieved using a water and acetonitrile gradient with 0.1% formic acid at a flow rate of 0.4 ml/minute. Samples were injected at a volume of 5 μL. The HPLC system was coupled to a Bruker Compass™ qTOF mass spectrometer calibrated to a mass range of 50 to 1700 m/z using the Agilent low-mass tuning mix. Each run was additionally calibrated to a reference mass solution injected at the beginning of each run. Bile acids were detected in negative mode, and identified by unique m/z and retention times compared to known pure standards and area under the peak determined using Bruker data analysis software. Metabolites were quantified using calibration curves generated from pure standards, ranging in concentration from 0.001 µM to 100 µM, in PBS. For fecal samples, individual bile acids are depicted as percent of total bile acid pool, where total bile acid pools were determined as a sum of all detected bile acids in the sample. For liver samples, the total bile acid levels were determined as the sum of all detected bile acids, normalized to sample tissue weight (nM/ng). Bile acids detected by LC-MS are listed in Table 4, as follows.

TABLE 4

| Conjugated 1° Bile Acids | 1° Bile Acids | 2° Bile Acids | Conjugated. 2° Bile Acids |
|---|---|---|---|
| Taurocholic acid (t-CA) | Cholic acid (CA) | Deoxycholic acid (DCA) | Tauro-deoxycholic acid (t-DCA) |
| Glycocholic acid (g-CA) | Chenodeoxycholic Acid (CDCA) | Lithocholic acid (LCA) | Glyco-deoxycholic acid (g-DCA) |
| Tauro-chenodeoxycholic acid (t-CDCA) | α-Muricholic acid (αMCA) | 3-Oxo-cholic acid (3-oxo CA) | Tauro-lithocholic acid (t-LCA) |
| Glyco-chenodeoxycholic acid (g-CDCA) | β-Muricholic Acid (βMCA) | 7-Oxo-cholic acid (7-oxo CA) | Glyco-lithocholic acid (g-LCA) |
| Tauro-α-muricholic acid (t-αMCA) | Hyocholic acid (HCA) | 12-Oxo-cholic acid (12-oxo CA) | |
| Tauro-β-muricholic acid (t-βMCA) | | 3-Oxo-chenodeoxycholic acid (3-oxo CDCA) | |
| Tauro-hyocholic acid (t-HCA) | | 7-Oxo-chenodeoxycholic acid) 7-oxo CDCA | |
| Glyco-hyocholic acid (g-HCA) | | 3-Oxo-deoxycholic acid) | |
| | | 3-oxo DCA | |
| | | 12-Oxo-deoxycholic acid (12-oxo DCA) | |
| | | 3-Oxo-lithocholic acid) | |
| | | 3-oxo LCA | |
| | | Iso-deoxycholic acid (Iso-DCA) | |
| | | Ursodeoxycholic acid (UDCA) | |

Gene Expression Profiling

Distal ileum samples, taken from mice at 3 days post-dosing, were flash frozen upon collection. RNA was isolated by homogenization followed by extraction using the Qiagen RNeasy® Plus Mini kit per manufacturer's instructions. Real-time qPCR reactions were run with an RNA-to-CT one step qPCR expression kit (Life Technologies, Carlsbad, Calif.), using ~50 ng RNA and with Taqman® primers to beta-actin, NR1H4 (Mm00436425_m1), NRB02 (Mm00442278_m1), or FGF15 (Mm00433278_m1). All gene expression was normalized to expression of the housekeeping gene, beta-actin.

hFXR Luciferase Reporter Assay

FXR reporter cell assays were performed by Indigo Biosciences as directed by Seres Therapeutics using Indigo's FXR reporter CHO cell line, which expresses an FXR receptor hybrid in which the native N-terminal DNA binding domain (DBD) has been replaced with that of a yeast Gal4 DBD. The reporter gene, firefly luciferase, is functionally linked to a Gal4 upstream activation sequence (UAS). Briefly, reporter cells were submitted to a serial dilution curve of CDCA, OCA, or vehicle (0.2% DMSO) and incubated at 37° C. for 24 hours in a high-humidity, 5% $CO_2$ chamber. Luminescence was determined following incubation with substrate and a detection reagent. In addition, live cell count was determined within the assay using a Live Cell Multiplex (LCM) Assay (Indigo Biosciences). Data are shown as normalized to the vehicle group (FIG. 7).

Analysis of Serum Alkaline Phosphatase Levels (ALP)

Whole blood or serum samples were used for ALP measurement. 100 µL of sample was loaded onto a VetScan mammalian liver profile disc (Abaxis) and analyzed using a VetScan VS2 series chemistry analyzed (Abaxis). ALP levels as well as additional serum biochemical analysis reports were printed out for comparison.

Methods described in this example are useful for identifying bacteria having specific bile acid metabolizing features. Other such methods are known to those in the art.

Example 2: Designed Compositions Demonstrate Specific Bile Acid Activities In Vitro In a germ-free mouse model, Applicants have demonstrated the targeted reduction of both total bile acid levels and specifically, the conversion of primary bile acids to their secondary counterparts using designed bacterial compositions. Applicants also demonstrated bile acid specific signaling in the intestine, influenced by the targeted restoration of secondary bile acid pathways by designed compositions. These experiments are described in further detail, below.

Figure 1B:
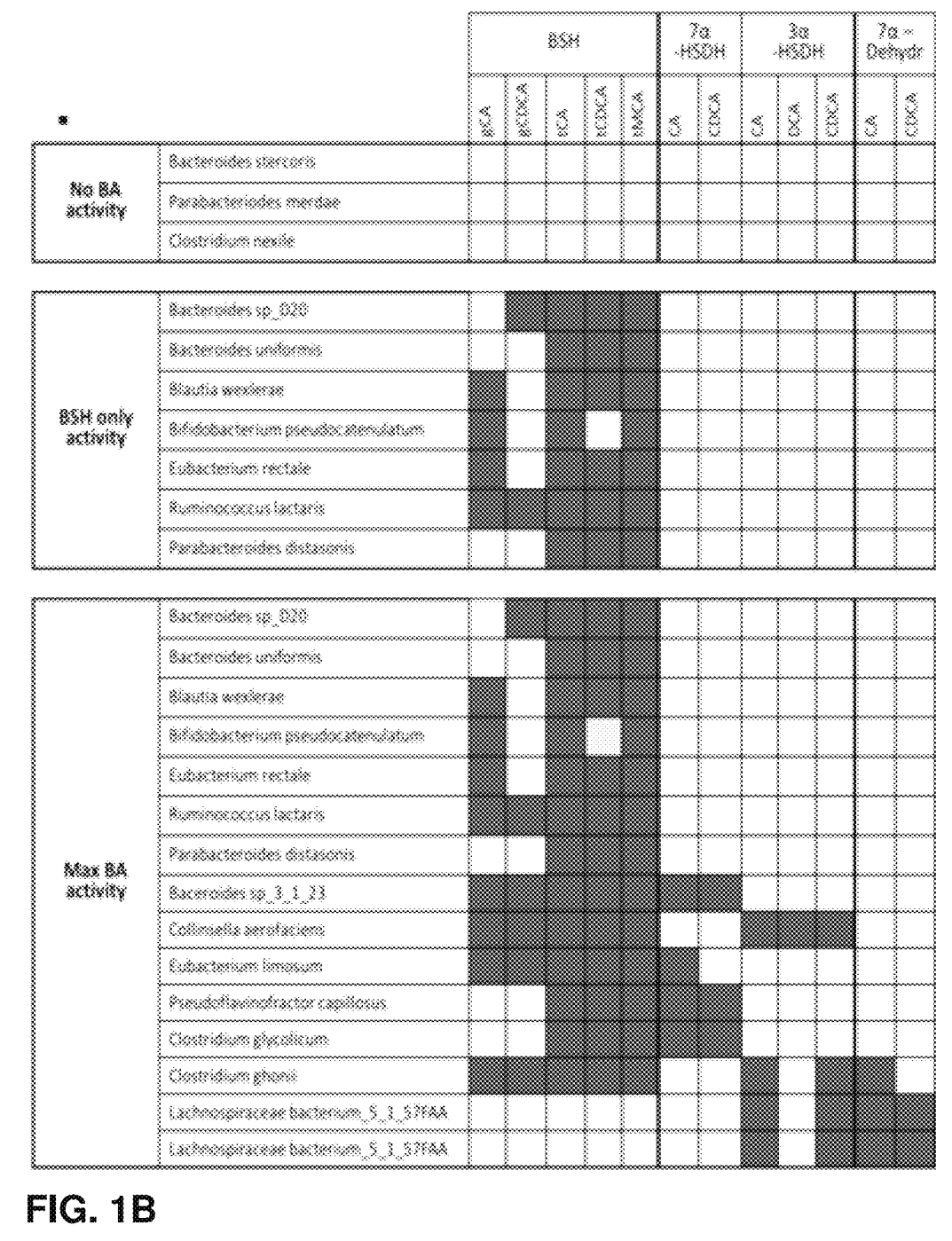

To create combinations of bacterial strains having specific metabolic activities, methods were designed for characterizing the bile acid metabolic activities of individual bacterial strains in vitro. Accordingly, an LC-MS based screening approach was used. Screening of nearly 200 strains resulted in the identification of a variety of bile acid metabolic activities including deconjugation, oxidation, and 7-alpha dehydroxylation (7α-deOH) in a number of human bacterial isolates; examples are shown in FIG. 1A (also see Table 3). Bile acid deconjugation is catalyzed by bile salt hydrolase (BSH). Different BSHs can exhibit preference for activity on different conjugated primary bile salts. In some cases, a bacterium has more than one BSH, at least two of which differ in substrate-specific activity from each other. For example, Applicants queried 1129 genomes represented in the Human Microbiome Project database for BSH sequences and discovered that 43% of those genomes had sequence corresponding to a BSH sequence and the genomes had between one and six such sequences. Accordingly, in some cases, a criterion for selecting a species for a DE is the presence of more than one BSH, e.g., the ability to metabolize multiple types of conjugated primary bile salts. In other cases, a species is selected for specificity, e.g., the ability to cleave only one specific conjugated bile salt. Oxidation reactions are catalyzed by hydroxysteroid dehydrogenase (HSDH), while 7α-dehydroxylation is a multistep process facilitated by the bai operon. Strikingly, for those cases in which multiple strains within a genus were tested, there was no obvious pattern of substrate specificity or enzyme activity for any of the three reactions tested. In addition, variations in specificity of levels of activity were also seen between multiple isolates of the same species from different donors.

As previously mentioned, the likelihood of species within a clade have similar functions remains high, providing a pool of species useful for generating compositions with specific function. The variation in activity between species and OTUs and strains (Table 3) however, makes the confirmation of activity in strains of interest, either by in vitro assays or genome analysis, a necessity for the construction of compositions with targeted bile acid metabolic capabilities.

Bacterial strains for which bile acid metabolizing activities had been determined were then tested in combinations designed to have specific bile acid metabolizing features. Three compositions with specific bile acid metabolic activities were designed and prepared (FIG. 1B). A control 'No BA activity' composition consisted of strains that, as single strains, showed no bile acid metabolizing activity when tested as described above. Furthermore, when used in the assay described above, the mixed composition did not exhibit any detectable bile acid metabolizing activity, suggesting that these strains, in combination with each other, had no complementary features with respect to bile acid metabolizing activity. The second composition, a 'BSH only activity composition,' consisted of strains whose only detected bile acid metabolizing activity was BSH activity, which resulted in a composition that was restricted to the deconjugation of primary bile salts and was unable to further modify the deconjugated, primary bile acids into their secondary derivatives. Conjugated bile salts tested included glycine and taurine conjugated cholic acid and chenodeoxycholic acid, as well as taurine conjugated α-muricholic and β-muricholic acids. The final composition, a 'max bile acid' (Max BA activity) composition, was designed to encompass BSH mediated deconjugation activity as well as the two secondary bile acid enzymatic activities described above oxidation, and 7α-dehydroxylation. The activity of the combination was confirmed in the in vitro assay (FIG. 1B).

These data demonstrate that in vitro methods can be used to construct compositions that are effective for altering bile acid metabolism.

Colonized Germ-Free Mice Rapidly Engraft with Species from Compositions

A germ-free mouse model of bacterial GI colonization was used to characterize the bile acid metabolic activities of a specific bacterial composition in vivo. Germ-free mice do not carry any microorganisms. Therefore, as long as the mice are maintained in a germ-free environment, introducing a specific bacterial composition into a germ-free mouse allows direct analysis of the bile acid metabolic activities of the composition.

Five germ-free mice were colonized with a "no bile acid activity" composition made up of three bacterial strains used in the in vitro experiments described supra. Fecal samples were collected prior to dosing with a composition and at 6 hours, 1 day, 3 days, and 7 days post-dosing, and analyzed by NGS to detect colonizing microbes. The colonization data below are reported at the level of bacterial clades. 16S v4 NGS sequencing allowed for accurate identification of bacterial clades with inferred species identifications. This was possible because the three species in the 'No bile acid' composition belong to distinct clades; in this case, analysis at the clade level provides accurate data pertaining to the strains present in the mice post-colonization.

All five mice were confirmed to be germ-free at the start of the experiment based on the lack of bacterial counts observed using NGS (see FIG. 2). No bacteria were cultured from the feces of mice pre-treatment, further confirming their germ-free state. By 24 hours, the microbiome of the treated mice had only sequences from clades to which the composition bacteria belong. Later time-points (3 days and 7 days) were also found to contain only the three clades to which bacteria in the "no bile acid" composition belong. This indicates that only bacteria in the composition stably colonized the GI tract of the germ-free mice. These data demonstrate that the germ-free model can be used to test for colonization experiments to assay compositions.

Colonized Germ-Free Mice Show Specific Fecal Bile Acid Profiles

To further examine the suitability of the murine colonization model for testing compositions related to bile acid metabolism and the ability of a bacterial composition to alter bile acid metabolism in a targeted manner, fecal samples from germ-free mice colonized with designed compositions were analyzed for bile acid composition and compared to germ-free and conventionalized control mice.

Only conjugated primary bile salts were detected in the feces of germ-free mice. Conjugated primary bile salts are synthesized by the liver, and their prevalence in the feces demonstrates a lack of the bile acid metabolism catalyzed by GI bacteria to produce (unconjugated) primary and secondary bile acids. Similarly, mice colonized with the no bile acid activity composition demonstrated a complete lack of detectable primary bile acids and secondary bile acids in fecal samples (FIG. 3), with a bile acid profile identical to untreated germ-free mice. In contrast, conventionalized mice, which are germ-free mice colonized with a fecal preparation from specific pathogen free mice (SPF mice), "Conventionalized" mice in FIG. 3, a process referred to herein as fecal microbiome transplantation (FMT), showed a diverse fecal bile acid profile (FIG. 3) similar to that seen in untreated wild-type mice, including a range of primary and secondary bile acids.

Figure 3:
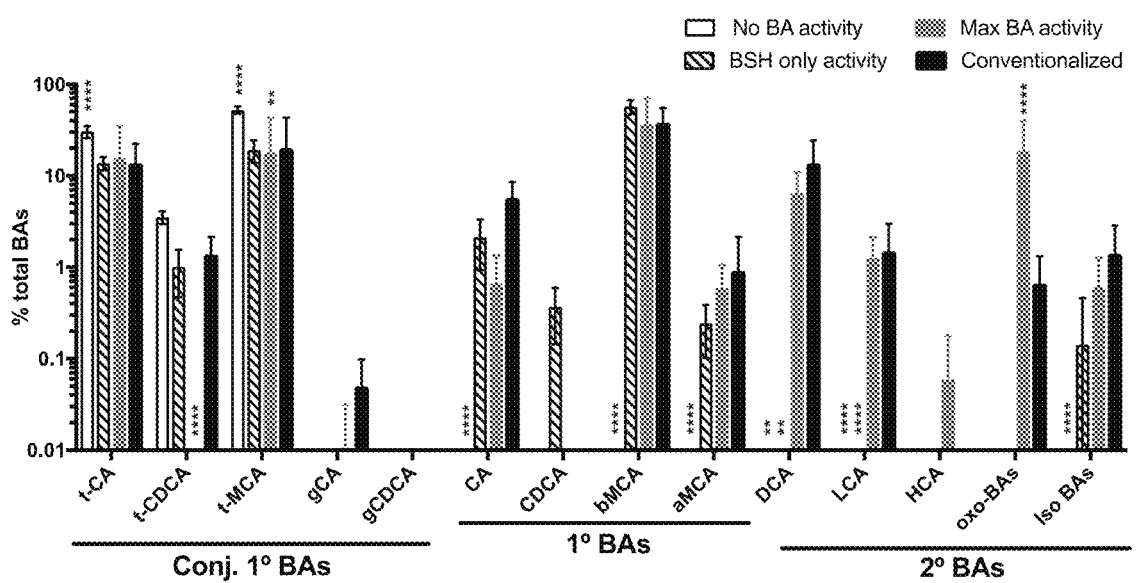
FIG. 3 depicts data from experiments testing whether colonization with designed compositions can alter fecal bile acid content in germ-free mice. Data illustrate the fecal bile acid profiles of germ-free mice colonized with a 'No bile acid (No BA) activity' composition, 'BSH only activity' composition, 'Max BA activity' composition, or 'Conventionalized' (mouse-derived FMT). Five mice were tested per treatment and bile acid profiles are depicted as percent of the total assayed bile acid pool (assayed bile acid pool means the sum of all detected bile acids in a sample). * indicates a significant difference compared to conventionalized mice, based on a two-way Anova with a Tukey's multiple comparisons test. P-values are as indicated: $p \leq 0.01$, **$p \leq 0.001$.

The first step in microbiome-mediated bile acid metabolism is deconjugation, the removal by a BSH of taurine or glycine residues from conjugated primary bile salts, to release free bile acids (Ridlon et al., JLR 47:247-259, 2006). Colonization of germ-free mice with a bacterial composition restricted to only BSH activity resulted in mouse fecal samples containing deconjugated primary bile acids (primary bile acids) in addition to the previously detected conjugated primary bile salts, but no downstream secondary bile acids (FIG. 3). In one case a single mouse had low levels of a mouse muricholic acid derivative, iso-bile acid (3a, 6a muricholic acid). This outlier bile acid detected in a single mouse was at levels 10 fold lower than typically seen in conventional wild-type mice and may be a byproduct of incomplete muricholic acid synthesis in the liver.

The data of this example demonstrate that conjugated primary bile salts can be deconjugated in vivo by introduction of a bacterial composition having BSH activity. Furthermore, this demonstrates that the in vivo activity can correspond to the in vitro activity of the composition (FIG. 1B).

After deconjugation of conjugated primary bile salts, the resulting primary bile acids are further modified by the GI microbiome into a range of secondary bile acids that can influence signaling and the regulation of bile acid metabolism in the liver. Colonization of germ-free mice with the Max BA activity composition for 7 days produced many deconjugated primary and secondary bile acids to levels similar to those seen in conventionalized mice colonized with the mouse SPF/FMT mouse fecal samples (FIG. 3). Secondary bile acids restored in Max BA colonized mice included 7α-dehydroxylated bile acids (DCA and LCA) and oxo-bile acids (7-oxo CA, 3-oxo CDCA, 12-oxo DCA, 3-oxo LCA) and iso-bile acids (UDCA), demonstrating that a significant portion of microbial bile acid metabolism can be restored with a designed bacterial composition. The sole observed exception was the iso-bile acid 3β, 12α-DCA, which was not detected in Max BA activity colonized mice. Without committing to any particular theory, formation of 3β, 12α-DCA requires bile acid isomerization activity specific to DCA, catalyzed by the 7β-HSDH enzyme, which was not selected for in the bacterial compositions for this experiment. This activity was likely not present in the Max BA activity composition.

tCDCA was detected in the conventionalized mice and was not detected in the max-BA mice (FIG. 3). This indicates that the Max BA composition completely converted all the tCDCA to DCA and oxo-bile acids, while the conventionalized mice did not, i.e., was more efficient at conversion of the conjugated bile acid than the microbiota composition of the conventionalized mice. This further demonstrates that a DE can selectively shape the bile acid pool in vivo and this feature can be useful in patients with disease associated with defects in bile acid metabolism or signaling.

Further, as shown in FIG. 3, the Max BA composition showed the presence of HCA activity while none was detected in the conventionalized mice. In this case, it is likely that HCA is not metabolized by the Max BA composition as completely as by the conventionalized composition. These data further demonstrate the usefulness of a designed composition having selected bile acid activities for altering the composition of a patient's bile acid pools, to selectively normalize or otherwise adjust the pools to ameliorate a bile acid associated disease.

Restoring Bacterial Bile Acid Metabolism in the GI Tract Lowered the Total Liver Bile Acid Pool In some aspects of the invention, cholestatic disease patients can benefit from a reduction in the bile acid pool. Primary and secondary bile acids signal through FXR to regulate bile acid synthesis in the liver, regulating the expression of CYP7A1 and other bile acid synthesis genes to decrease bile acid production when present (Hylemon et al., JLF 50:1509-1520, 2009). Germ-free mice lacking a primary and secondary bile acid pool reportedly had increased bile acid production and higher total bile acid levels compared to conventional mice (Sayin et al., Cell Metab. 17:225-2235, 2013). To determine the effect of designed bacterial compositions on bile acid synthesis, total liver bile acid pools of germ-free mice, mice colonized with a designed composition, and conventionalized mice were assayed using methods described supra.

Figure 4:
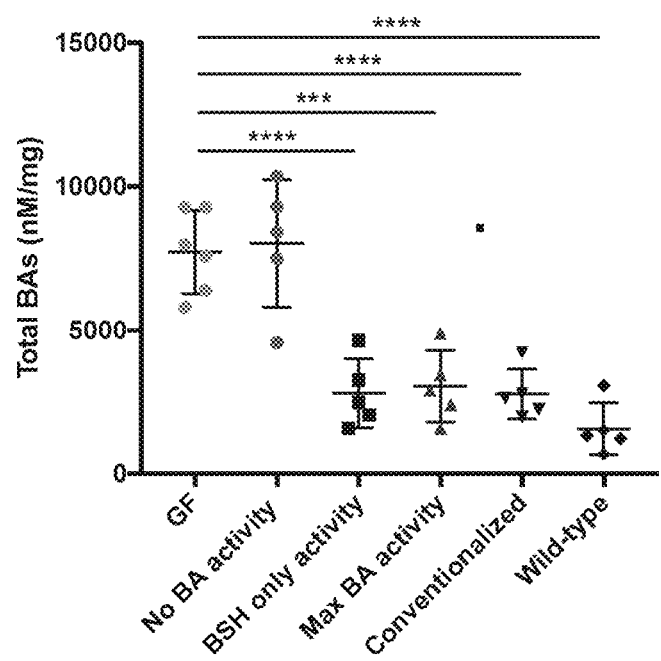
FIG. 4 depicts the results of experiments examining whether catabolism of conjugated primary bile salts by bacteria can decrease liver bile acid pools. Total liver bile acid pools were measured in wild-type, conventionalized, and germ-free mice, as well as mice colonized with 'No BA activity', 'BSH only activity,' or 'Max BA activity' compositions. Five mice were tested in each arm, total liver bile acids were assayed using LC-MS, and results were normalized to sample tissue weight (nM/mg). Total bile acid pools were determined as the sum of all detected bile acids in liver tissue and quantified using calibration curves with pure standards. * indicates a significant difference in total bile acid levels compared to germ-free mice based on a paired t-test. P-values are as indicated: *$p \leq 0.001$, **$p \leq 0.001$.

In these studies, germ-free mice had elevated liver bile acid pools compared to FMT/conventionalized mice and to wild-type mice (FIG. 4). Colonization with the no BA activity composition had no effect on total bile acid pools, which remained elevated and comparable to untreated germ-free mice. Colonization with either the BSH only or the Max BA compositions resulted in a significant decrease in total liver bile acid pool, to levels comparable to wild-type mice (FIG. 4), i.e., there is signaling through bile acid receptors by both primary and secondary bile acids, thereby impacting the bile acid pool in the liver.

FGF15 is Differentially Regulated in Response to Bacterial Compositions with Specific Bile Acid Activities Bile acids, particularly the unconjugated primary bile acid CDCA, have been reported to signal in the ileum through the farnesoid X receptor, FXR (NR1H4), resulting in the upregulation of FGF15. FGF15 acts on the liver to reduce bile acid synthesis, and therefore reduces the total bile acids in the enterohepatic system. Accordingly, FGF15 gene expression was used as a biomarker to test whether changes in bile acid profiles induced by a designed bacterial composition can alter function, in particular, FXR signaling. As reported in the literature, FXR levels themselves were not expected to change (Sayin et al., Cell Metab. 17:225-235, 2013; Song et al., Tox. Appl. Pharmacol. 283:57-64, 2015).

Figure 5A:
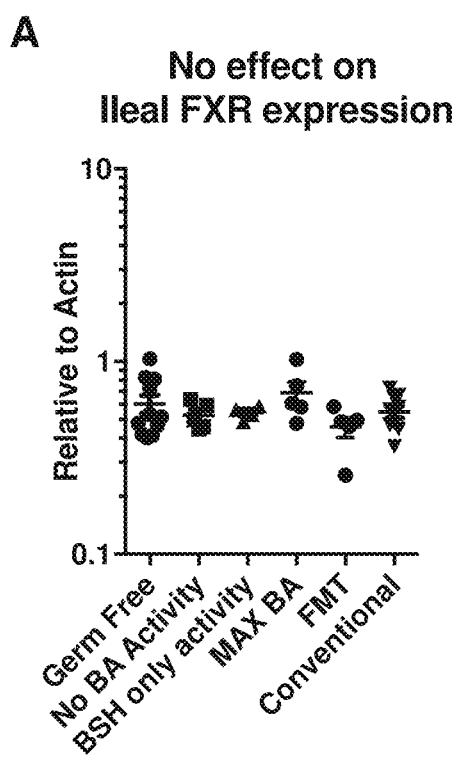
FIG. 5A illustrates the results of experiments examining whether colonization of germ-free mice with bacterial compositions with differing bile acid catabolic activities can significantly alter ileal FXR gene expression. Gene expression was assessed by Taqman qPCR in ex-germ-free mice colonized with either a no bile acid activity (No BA Activity), BSH only activity, or Max BA activity composition. Controls include ex-germ-free mice colonized with murine stool via oral gavage ("FMT) and conventional mice with a murine microbiota. Expression is shown as relative to the housekeeping gene, beta-actin. ****$p \leq 0.0001$ by Tukey's multiple comparisons (n=4-8).
Figure 5B:
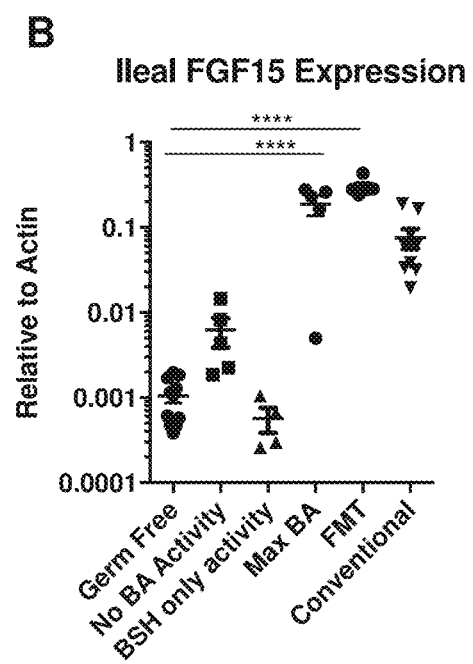
FIG. 5B illustrates the results of experiments demonstrating that colonization of germ-free mice with bacterial compositions that have distinct bile acid activities differentially affected ileal FGF15 gene expression. Ileal FGF15 expression was assessed in germ-free mice, conventionally housed mice, germ-free mice colonized with a murine-derived FMT as well as mice colonized with a 'No BA activity composition', a 'BSH only activity' composition or a 'Max BA activity' composition. Expression is shown as relative to the housekeeping gene, beta actin. ****$P<0.0001$ by Tukey's multiple comparisons (n=4-8).

In these experiments, germ-free animals colonized with a murine-derived fecal microbiome transplant (FMT) significantly upregulated FGF15 gene expression (200×-300×) compared to germ-free animals (FIG. 5B). FGF15 levels of these conventionalized mice were comparable to those observed in wild-type conventional mice. These data confirm a role for the complex GI microbiome in regulating FXR signaling. Mice colonized with a defined bacterial composition containing maximal bile acid activity also had increased FGF15 levels compared to germ-free mice. These data demonstrate the restoration of FXR signaling in the presence of secondary bile acids (FIG. 5B). Surprisingly, animals given a composition with no bile acid activity showed small increases in FGF15 levels (~8 fold), indicating that some FGF15 activity can be induced by the presence of a microbiome independently of secondary bile acid metabolism (FIG. 5). The levels of FGF15 in the mice colonized with the no bile acid composition did, however, remain significantly lower than the levels observed in conventional or maximum bile acid activity colonized mice. In contrast, mice colonized with the BSH only activity composition, which produced primary bile acids but no secondary bile acids and was predicted to activate FXR, showed no changes in FGF15 expression (FIG. 5B).

Co-Treatment with Primary Bile Acid CDCA Enhances Activity of OCA In Vitro

Obeticholic acid (OCA) is FDA approved for treating primary biliary cholangitis (PBC), typically in combination with ursodeoxycholic acid or, in some patients, as a single treatment regimen. It is also in clinical development as a treatment for PSC and NASH. However, OCA can have undesirable side effects. Obeticholic acid, an FXR agonist, is a synthetic derivative of CDCA that is reportedly 100× more potent in activating human FXR compared to CDCA.

Experiments were conducted using a human FXR reporter cell line to confirm reported differential potencies of OCA and CDCA relative to vehicle (FIG. 6). In a luciferase-based assay, reporter cells were incubated with serial dilutions of either OCA or CDCA, with a readout of FXR activity. FXR binds to bile acids and then becomes active as a transcriptional regulator. OCA was almost 100× more potent compared to CDCA. We then determined the effect of coincubation of CDCA with OCA on activation of FXR. Surprisingly, the addition of $EC_{50}$ (50 uM) of CDCA affected the FXR activity of OCA. In the presence of CDCA, the OCA dose-response curve was left shifted about 20-fold, indicating that addition of CDCA to OCA can increase OCA efficacy (FIG. 6A).

Figure 6A:
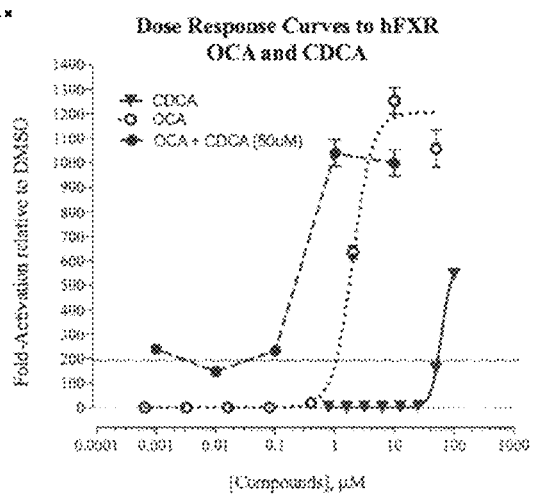
FIGS. 6A-6D depict the results of experiments testing the ability of obeticholic acid (OCA) to mediate FXR-activated gene expression in the presence of CDCA. The ability of obeticholic acid (OCA) to stimulate expression of downstream target genes was enhanced 20-fold in the presence of CDCA.
Figure 6B:
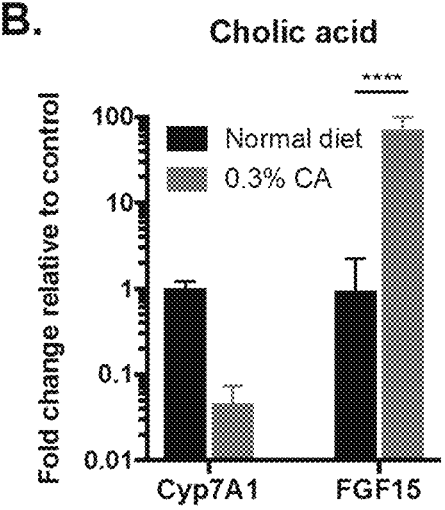
Figure 6C:
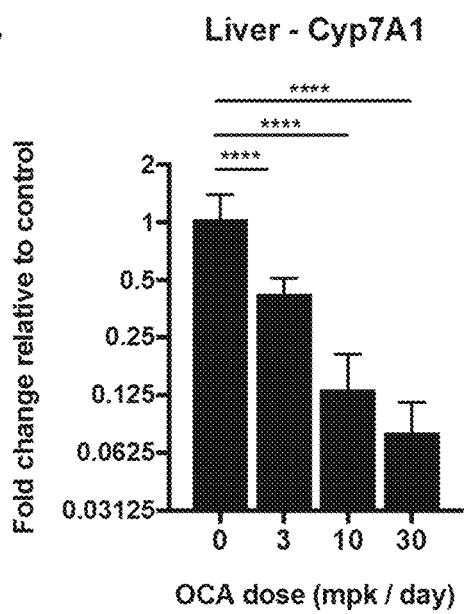
Figure 6D:
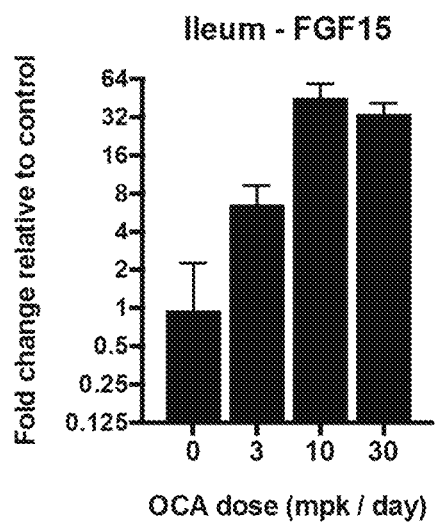

Given the side effects associated with current OCA dosing standards, a lower dose of OCA could significantly improve patient experience while still providing effective treatment. To determine if bile acid co-treatment improves OCA efficacy in-vivo, we first identified dose ranges for effective FXR signaling of OCA and bile acids of interest in a mouse model. In the mouse, chenodeoxycholic acid constitutes an insignificant portion of the bile acid pool, while cholic acid (CA) appears to be the more potent ligand for FXR (Song et al., Tox. Appl. Pharmacol. 283:57-64, 2015). We therefore tested a dose range of OCA as well as a fixed concentration of CA for their effects on FXR signaling in mice. Ileal and liver FXR signaling was monitored based on the expression of CYP7A1 (liver) and FGF-15 (Ileum). OCA administration resulted in a dose dependent decrease in CYP7A1 expression and an increase in FGF-15 levels (FIG. 6C-D), suggesting effective signaling through FXR in both the liver and the ileum. A cholic acid supplemented diet also decreased CYP7A1 expression and increased FGF-15 levels in the ileum, suggesting FXR activation in with CA supplementation (FIG. 6B).

We next determined if co-treatment of cholic acid with OCA can improve efficacy of OCA signaling through FXR, thus lowering the effective concentrations of OCA required for effective therapy. In PBC patients that respond to UDCA treatment, OCA is recommended as a single daily dose of 5 mg, with the option to increase dosing to 10 mg in the absence of a response after 3 months. Dosing at these concentrations has been associated with side-effects, particularly pruritus. Increasing the efficacy of OCA with a microbiome composition that produces primary bile acids such as cholic acid (CA) or chenodeoxycholic acid (CDCA), can result in equivalent efficacy at a lower dose, and may alleviate OCA-related side effects while still achieving effective treatment. Reduction in dosing amount or frequency may also increase the number of patients able to successfully tolerate treatment with OCA, thereby providing treatment to a broader population.

In view of this discovery, in some embodiments, the invention relates to a bacterial composition that can increase CDCA and/or cholic acid if administered to a patient undergoing OCA treatment. In some cases, the composition can also modulate (e.g., decrease) HSDH and 7α-dehydroxylation activity.

CDCA Enhances the Efficacy of the Non-Active Hyocholic Acid in a Dose Dependent Manner Hyocholic acid (HCA; is a 6-α-hydroxy muricholic acid; OCA is a 6-α-ethyl cholic acid) is a bile acid that is reported to be present at moderate levels in fetal bile and is present in lower levels in adult humans (Setchell et al., J. Biol. Chem. 263:16637-16644, 1988). HCA has no known functional properties. Using the in vitro reporter assay described supra, Applicants tested whether HCA had hFXR agonist activity. Results are depicted in FIG. 8.

Figure 7A:
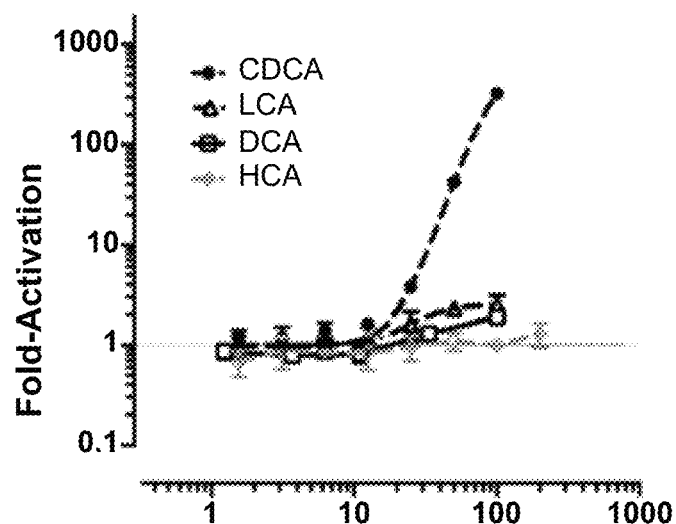
FIG. 7A depicts the results of experiments demonstrating that CDCA, but not HCA, activates FXR signaling in-vitro. Dose response curves of selected bile acids alone in an hFXR luciferase cell reporter assay indicate full agonist activity of CDCA, low agonist activity of LCA and DCA (maximum concentration tested was 100 μM) and no agonist activity of hyocholic acid (HCA; up to 200 μM) on FXR signaling.
Figure 7B:
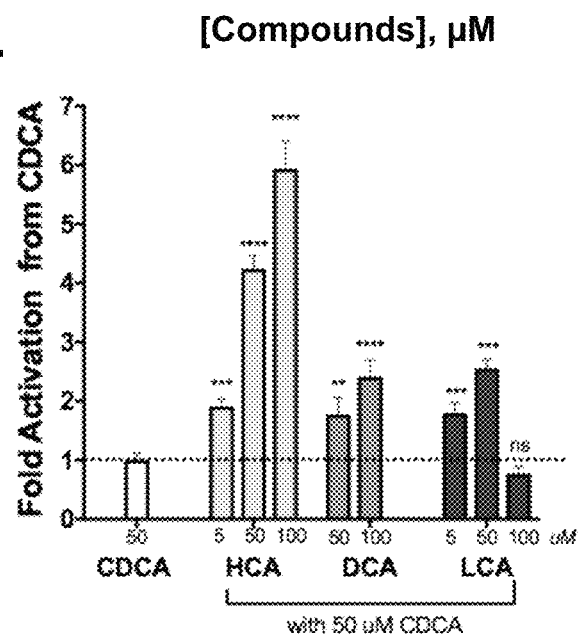
FIG. 7B: Dietary supplementation with a cholic acid diet resulted in increased FXR signaling in vivo.

In these experiments, HCA alone had no human FXR agonist activity at concentrations up to 200 uM compared to that of CDCA and was even less active than the relatively weak agonists, LCA and DCA (FIG. 7A). Surprisingly, in the presence of 50 uM CDCA, HCA activated human FXR in a dose-dependent and synergistic manner (FIG. 7B). This effect was not seen with CDCA in combination with DCA or LCA, which upregulated hFXR agonist activity in a more additive fashion; although the combination with LCA did show toxicity at higher concentrations (100 µM) (bottom graph). Without committing to any particular theory, it may be that CDCA potentiates bile acids modified at the 6-α position.

These data indicate that bacterial compositions that can upregulate CDCA and/or HCA can be used to enhance endogenous FXR signaling to treat cholestatic diseases.

Example 3: Treatment of a Murine Model of Cholestatic Disease

Mice lacking the MDR2 gene develop cholestatic disease (Tabibian et al., Hepatology 63(1): 185-196, 2016). Germ-free MDR2–/– mice develop a more rapid and severe cholestasis, presumably because of cholangiocyte toxicity from bile lacking appropriate amounts of phosphatidylcholine in addition to the lack of microbiome synthesized primary and secondary bile acids. Colonizing these mice with bacteria that are either unable to deconjugate primary bile salts or to make secondary bile acids (No BSH and BSH-only compositions as above) and comparing the progression of disease with mice that are colonized with a microbiome that is able to make a full suite of secondary bile acids (Max BA as above) demonstrates the ability to control progression of cholestasis through interventions into the microbiome.

The germ-free mdr2–/– mouse can also be used to model the efficacy of a specific composition for ameliorating cholestatic disease or symptoms of cholestatic disease. Mouse models colonized with poorly protective microbiomes, such as a No BA activity composition, are expected to develop disease more rapidly or to a greater extent compared to colonizing such mice with a composition that can enhance bile acid metabolism, such as a BSH activity only composition or a Max BA activity composition. Such compositions are evaluated using a mouse model, monitoring the effects of a composition that can increase primary and/or secondary bile acid metabolism on the progression and severity of cholestatic disease. Germ-free interventional mouse models useful in such evaluation of a composition include the germ-free mdr2–/– deletion model or the DDC-induced chemical models of cholestatic disease in wild-type mice (e.g., Fickert et al., Am. J. Pathol. 171:525-536, 2007). Antibiotic treatment in conventional mdr2–/– mice can be used as an additional model; using antibiotics to deplete a dysfunctional microbiome that is then replaced with a protective composition. A microbiome that can improve secondary bile acid metabolism, such as the BSH only or Max BA composition, can slow progression of disease and reduce severity of pre-existing cholestatic disease.

Example 4

Decreased Secondary Bile Acid Levels in PSC Patients

In Primary Sclerosing Cholangitis (PSC), the blockage of bile ducts is thought to result in significant changes in bile acid concentrations in the hepatobiliary system and peripheral tissues of patients, leading to altered signaling and tissue damage in the liver (Chazouillers, Clin. Res. Hepatol. Gasteroentrology 36:S21-S25, 2012). Work by Trottier et al. (Trottier et al., Dig. Liver Dis. 44:303-310, 2012) has shown that there is a significant increase in total bile acids, accompanied by a drop in secondary bile acids, in the peripheral serum of patients with PSC. Changes in bile acid levels in systems linked to hepatobiliary circulation, such as bile or portal serum, however, are not well characterized. Here, we profile 25 unique bile acids in portal, bile and peripheral serum from 7 patients with PSC (end stage liver disease). These measurements were compared with those of 12 healthy donors and showed a significant change in total levels, as well of composition, of bile acids in patients with cholestatic liver disease.

Total bile acid levels were significantly elevated in peripheral serum and were also increased in portal blood compared to healthy donors (FIG. 8A). In contrast total bile acid levels in bile were significantly lower in patients with PSC, suggesting a decrease in the flow of bile from the liver gall bladder and indicative of a block in bile ducts (FIG. 8A). The corresponding increase in bile acids in serum may consequently reflect an accumulation of bile acids in the liver that are leaked out into serum. When broken down into their constituent bile acid groups, levels of conjugated and unconjugated microbial-derived secondary bile acids were decreased in peripheral and portal serum and bile (FIG. 8B). This included bile acids produced by microbial-catalyzed activities such as 7α-dehydroxylation and HSDH. Unconjugated primary bile acids, also generated by microbial BSH activity in the gut, were decreased in peripheral serum and to a smaller extent in portal serum as well. These changes were accompanied by an increase in the up-stream conjugated primary bile acids synthesized by the liver, suggesting an impairment in the primary and secondary bile acid metabolic pathways catalyzed by the gut microbiome. This decrease in microbiome synthesized bile acids suggests an altered microbiome in patients with liver disease, and potentially compromised signaling in the liver.

Mouse Model of Cholestatic Disease Shows Changes in Bile Acid Profile that are Comparable to Human PSC Patients Two mouse models, an mdr2−/− deletion model that develops disease over the course of a year (see above), as well as the more rapid DDC-diet induced cholestasis model, are currently utilized to study the progression of cholestatic liver disease. The DDC-diet model was recently published as an alternative to the genetic mdr2−/− knock out model of cholestatic disease (Fickert et al., Am. J. Pathol. 171(2):525-536, 2007). This model demonstrates the blockage of bile ducts typically seen in PSC patients and shows the elevated ALP and ALT serum levels also associated with cholestatic disease in PSC. The effect of DDC-diet induced cholestatic disease on bile acid metabolism in mice, however, remains unknown.

Figure 9A:
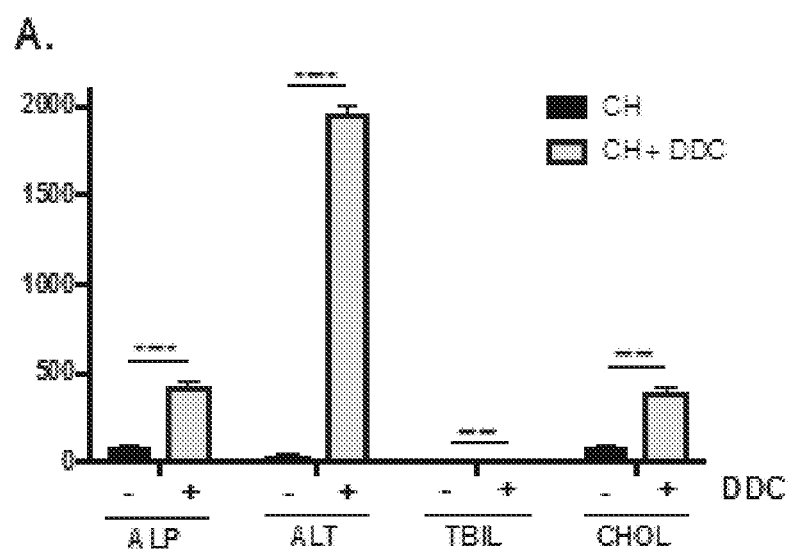
Figure 9B:
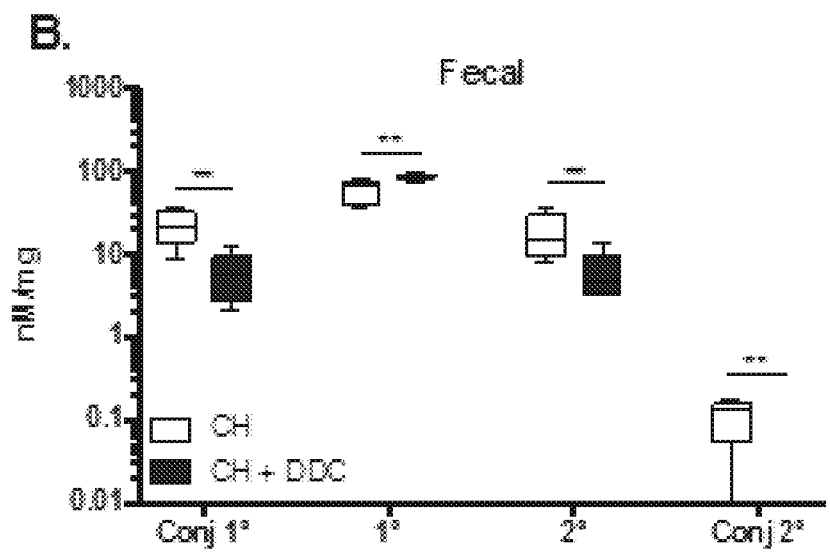
Figure 9C:
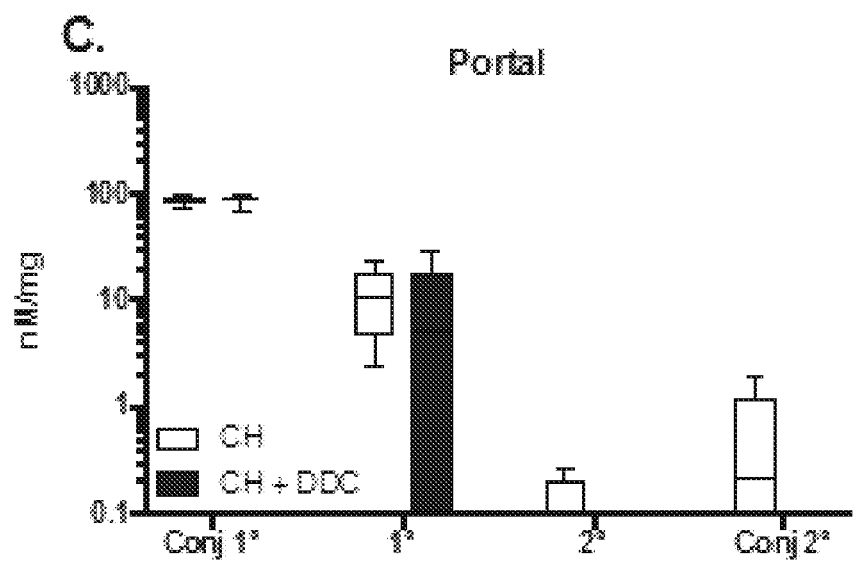
Figure 9D:
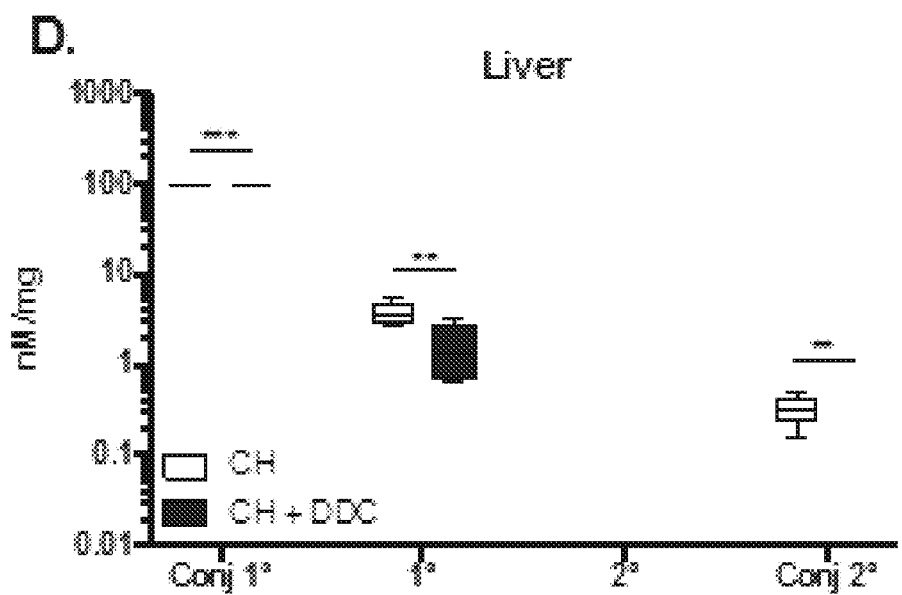

To assess changes in bile acid content, conventionally housed C57Bl/6 mice were placed on the DDC-diet and monitored for body weight loss. Disease severity was assessed based on weight loss, serum biochemistry, and overall health. At 21 days of treatment, mice on the DDC diet show elevated levels of ALP, ALT, total bilirubin, and cholesterol (FIG. 9A), confirming the development of cholestatic disease. Fecal, liver, and portal blood samples from these mice were then assessed for bile acid content compared to healthy untreated controls.

Figure 9G:
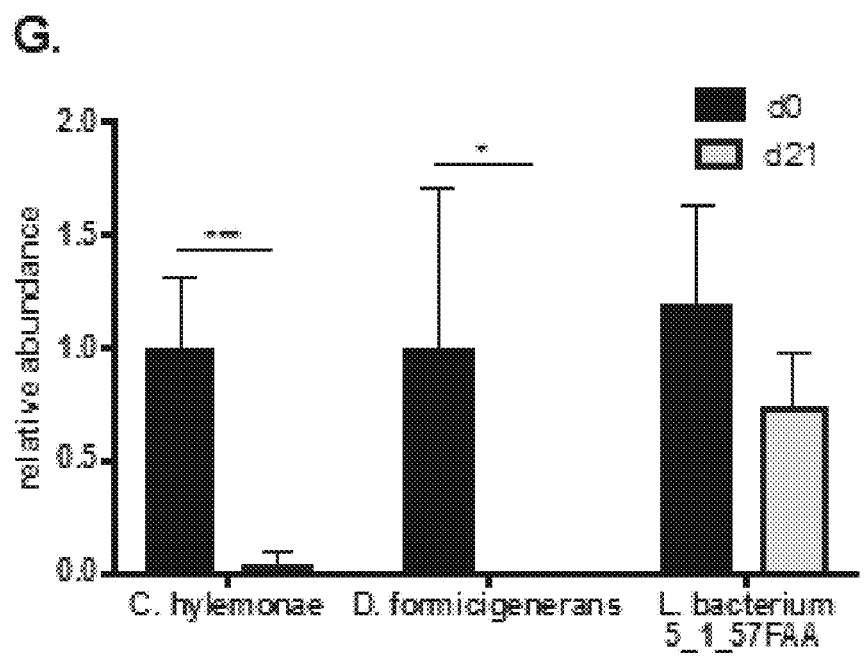
Figures 10A, 10B, 10C, 10D, 10E:
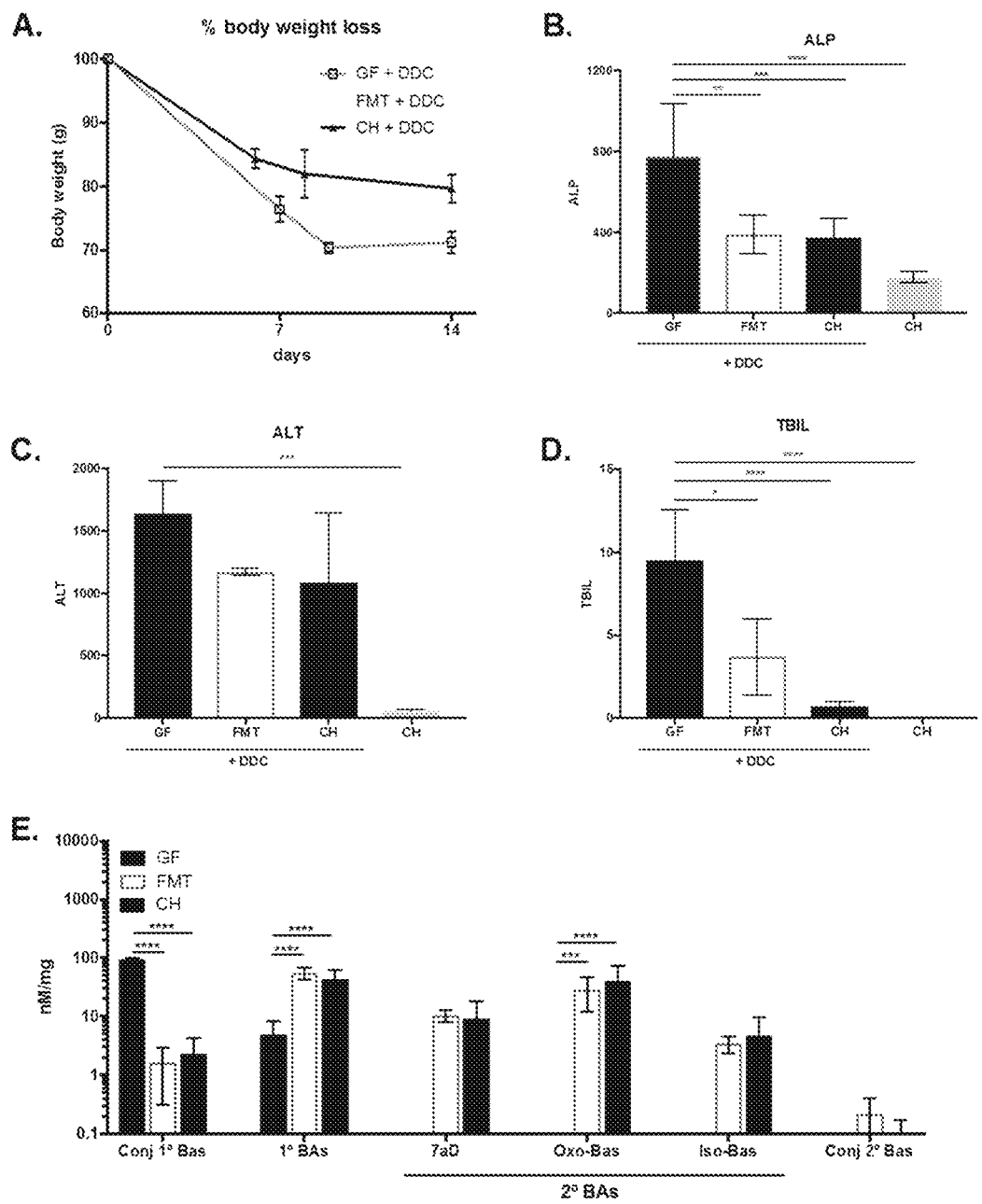
FIGS. 10A-10E show that the absence of a gut microbiome results in increased susceptibility to DDC-diet induced cholestatic disease in Swiss albino mice, a condition that can be reversed by colonization with a mouse-derived FMT. Germ-free (GF) mice show more rapid weight loss (FIG. 10A) and significantly higher levels of serum biomarkers such as alkaline phosphatase (FIG. 10B), alanine aminotransferase (FIG. 10C), and total bilirubin (FIG. 10D) compared to conventionally-housed (CH) mice when treated with the DDC diet. Colonization for 4 weeks with a Swiss albino mouse-derived self-FMT in GF mice reverses this susceptibility to DDC-induced disease, with body weight loss and levels of ALP, ALT and TBIL reduced to levels comparable to CH mice given DDC-diet.

Mice treated with the DDC diet demonstrated a decrease in relative abundance of unconjugated and conjugated secondary bile acids in fecal, liver, and portal samples (FIG. 9 B-D, 2°, Conj. 2°), a trend similar to what we observed in PSC patients characterized above (FIG. 8). This decrease in microbial derived secondary bile acids again suggested an alteration to the gut microbiome with cholestatic disease. To determine the effect of liver disease on the gut microbiome, we used 16S NGS sequencing to profile the fecal microbial content of mice before (day 0) and after (day 21) the development cholestatic disease (DDC-treated. Mice with cholestatic liver disease showed a significant decrease in alpha diversity based on the Shannon diversity index, suggesting a loss in species richness with disease development (FIG. 9E). An assessment of beta-diversity also indicated a significant shift in the composition of the microbiome in mice with liver disease (FIG. 9E), with the microbiome of cholestatic mice forming a distinct cluster from those of healthy mice on a PCoA plot. FIG. 10F lists species with whose prevalence was significantly (p≤0.2) altered with the development of liver disease in mice. In addition to the significant depletion of a number of species, specific strains known to possess 7α-dehydroxylation activity based on in vitro analysis, were also depleted in mice with cholestatic disease (FIG. 9G). 7α-dehydroxylation is required for the production of two major secondary bile acids—deoxycholic acid (DCA) and lithocholic acid (LCA). These same bile acids are also depleted in mice treated with the DDC-diet (FIG. 10B-10D). Changes in the bile acid composition of the DDC-mouse model thus provides a comparative model for studying cholestatic disease in humans.

Absence of a Microbiome Increases Susceptibility to Cholestatic Disease

Previous studies have shown that in the mdr2−/− deletion model, the absence of a microbiome leads to more rapid development of cholestatic liver disease. We therefore first assessed the importance of the microbiome to disease development in the DDC-diet induced model of cholestatic disease. Germ-free Swiss albino mice were placed on a sterile DDC supplemented diet and monitored for disease development. Body weight loss, serum biochemistry and overall health were used to monitor progression of disease. In parallel, conventionally housed Swiss albino mice were also placed on the DDC diet. Germ-free mice showed rapid weight loss (FIG. 10A) and more severe alterations to liver biochemistry (FIG. 10 B-D) compared to conventional mice, suggesting that the microbiome plays a crucial role in resistance to liver disease.

Colonization with a Mouse Derived FMT Restores Bile Acid Metabolism and Resistance Cholestatic Disease in Germ-Free Mice To further demonstrate the importance of the microbiome in resistance to cholestatic disease, we colonized germ-free Swiss albino mice with a mouse FMT derived from conventionally housed Swiss albino mice. The germ-free mice were allowed to colonize for 4 weeks followed by treatment with the DDC-supplemented diet to induce cholestatic liver disease. Mice treated with the FMT developed disease at a slower rate compared to germ-free mice and were comparable to conventional mice in their response to the DDC-diet (FIG. 10). Both body weight loss and serum ALP levels were lower in the FMT colonized mice compared to germ-free Swiss albino mice, suggesting that restoring a healthy microbiome is sufficient to extend resistance to DDC-induced cholestatic liver disease. Bile acid profiling also determined that FMT treatment was sufficient to restore bile acid composition in the gut compared to germ-free mice (FIG. 10E).

Microbial Composition Determines Susceptibility to Cholestatic Disease

Figures 11A, 11B, 11C, 11D, 11E:
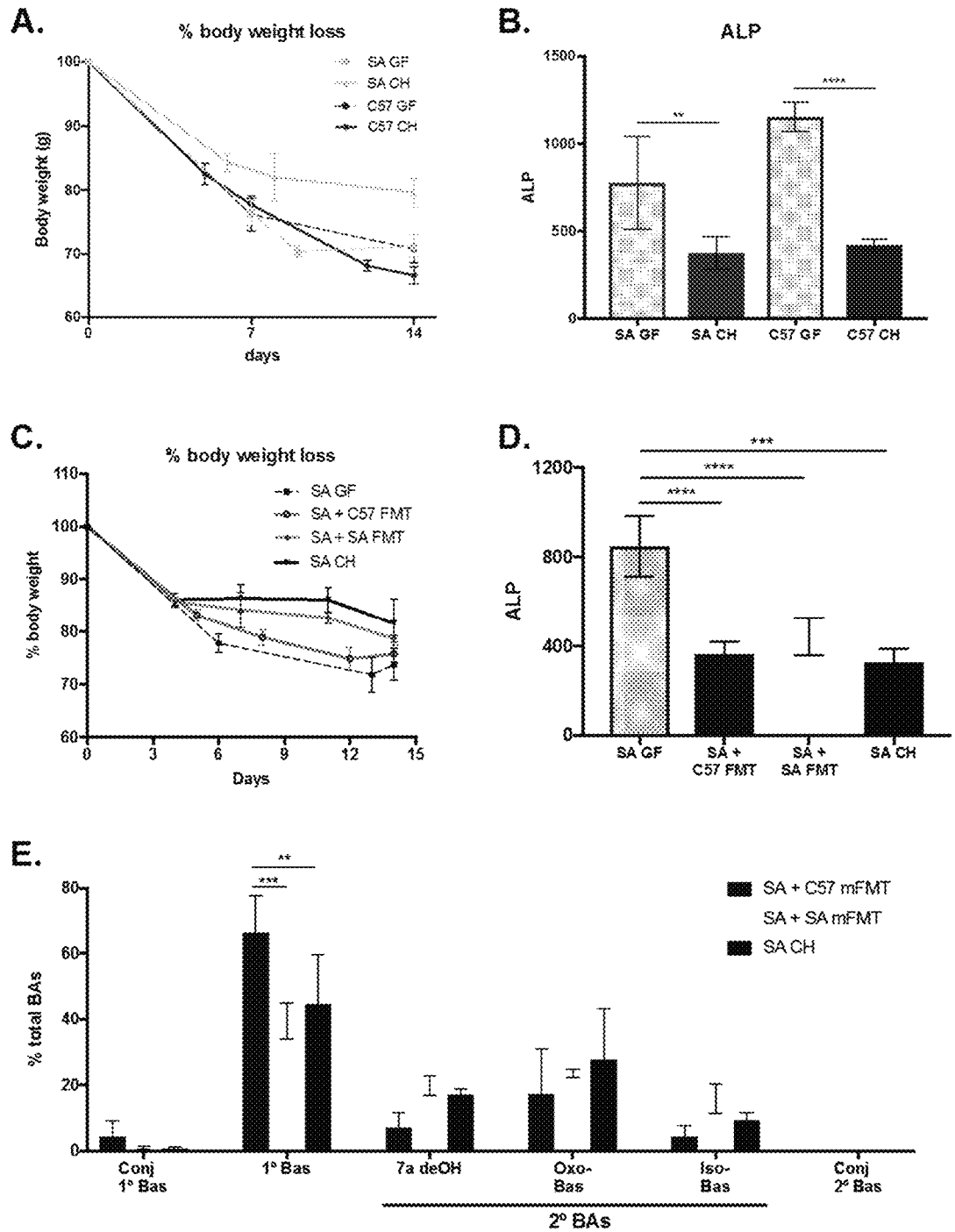
FIGS. 11A-11E show that microbial composition affects susceptibility to DDC-diet induced cholestatic liver disease.

When conventional Swiss albino and C57Bl/6 background mice were placed on the DDC-supplemented diet, mice from the C57Bl/6 background were more susceptible to diet induced liver disease compared to Swiss albino mice (FIGS. 11A-11B). C57Bl/6 mice showed more rapid body weight loss compared to Swiss albino mice of the same age. Serum levels of ALP, however remained comparable. In the absence of a microbiome, however, germ-free Swiss albino mice were no longer resistant, and developed disease at a rate comparable to C57Bl/6 mice (FIGS. 11A-11B), suggesting that microbiome composition, rather than genetic background, might determine susceptibility to liver disease in mice. Germ-free Swiss albino and C57Bl/6 mice lost body weight at a similar rate and showed elevated ALP levels in the serum. The C57Bl/6 mice had slightly higher ALP levels, suggesting some further progression of disease in that genetic background.

To further compare the role of the microbiome between two genetically distinct strains, we determined the effect of a C57Bl/6 derived microbiome on the susceptibility of a Swiss albino mice to DDC-diet induced cholestatic disease. Germ-free Swiss albino mice were treated with either a C57Bl/6-derived or a Swiss albino-derived fecal microbiome transplant (FMT) and allowed to colonize for 4 weeks. Mice were then placed on a DDC-supplemented diet (0.1%) and monitored for development of cholestatic disease. Body weight loss and serum biochemistry were the primary markers of disease, while bile acid metabolism and liver histology were used as additional markers of microbiome functionality and disease development.

Swiss albino mice colonized with a C57Bl/6 derived FMT showed more rapid early weight loss compared to mice colonized with a Swiss albino derived FMT (FIG. 11C) despite comparable serum ALP levels (FIG. 11D). C57Bl/6 colonized mice looked more similar to germ-free mice in their response to the DDC diet, while Swiss albino colonized mice resembled conventional mice in their response, suggesting a link between their starting microbiomes and progression of disease. To further assess the potential role of the different microbiomes, we compared fecal bile acid profiles of mice colonized with the C57Bl/6-derived FMT to mice colonized with the Swiss albino derived FMT prior to DDC treatment. Mice treated with the C57Bl/6 sourced FMT had significantly higher levels of primary bile acids and lower levels of 7-alpha dehydroxylated and isomerized secondary bile acids compared to mice treated with a Swiss albino derived FMT at baseline (FIG. 11E). This demonstrates a significant difference in metabolic activity between the two microbiomes (C57Bl/6 vs. Swiss albino) and may account for the differences in susceptibility seen between the two mouse strains. The depletion of secondary bile acids in the more susceptible C57Bl/6 FMT colonized mice mimics the loss of secondary bile acids seen in PSC patients (FIG. 8) and in the mouse model of cholestasis (FIG. 9), again pointing to a role for microbial bile acid metabolism in progression of cholestatic liver disease.

Restoring Microbial Bile Acid Metabolism with a Designed Composition Rescues Susceptibility of Germ-Free Mice to Cholestatic Disease The above results indicate a significant role for the microbiome in protection against DDC-diet induced liver disease. In particular, changes in bile acid metabolism with liver disease progression, and the increased susceptibility to liver disease in mice with decreased secondary bile acid levels, suggests a role for microbial bile acid metabolism and bile acids themselves in the response to cholestatic liver disease.

Figures 12A, 12B, 12C:
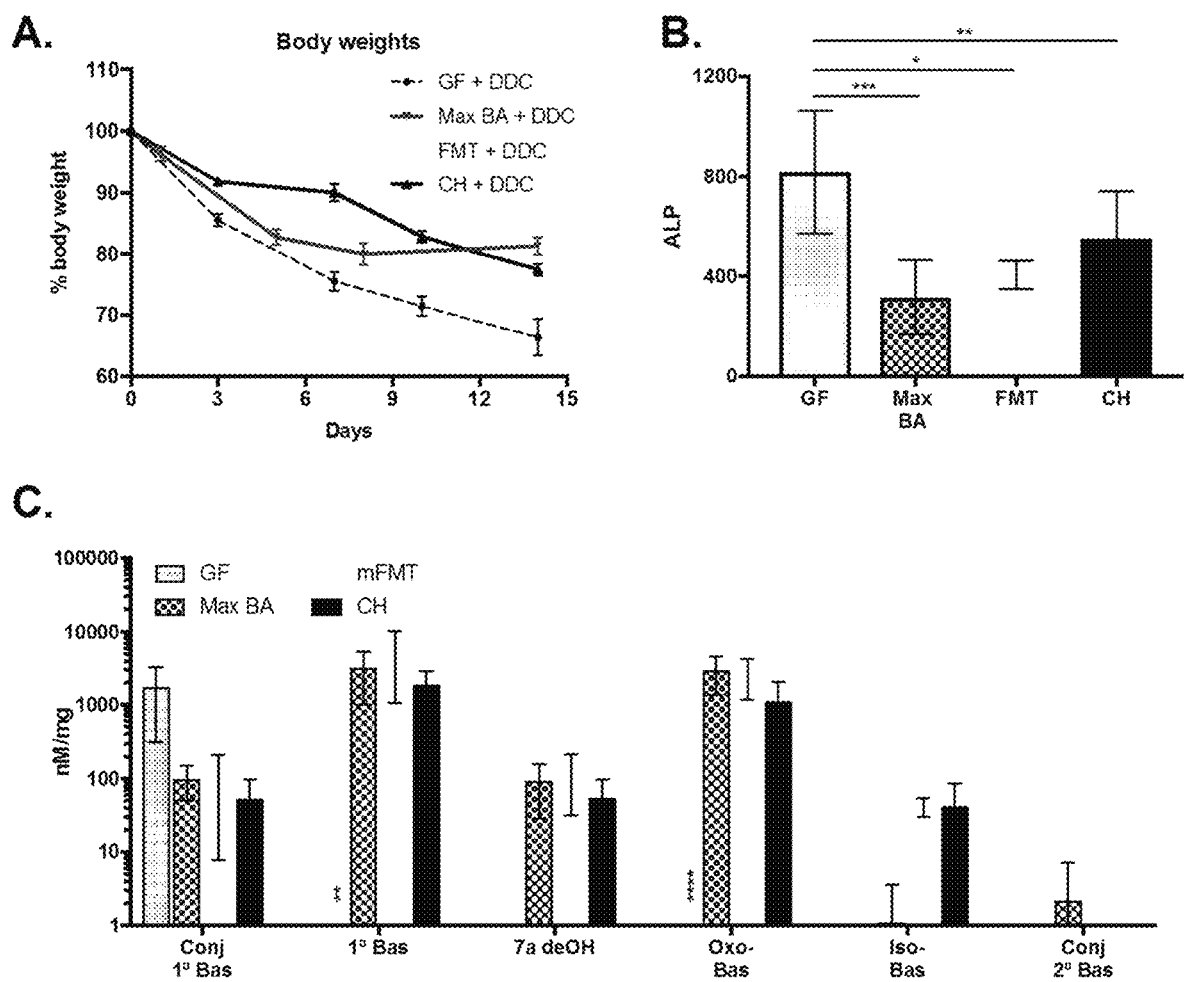
FIGS. 12A-12C show that restoring the microbiome rescues the susceptibility of germ-free mice to DDC diet induced liver disease. Treatment with either a complex conventional Swiss albino mouse derived FMT or a less complex designed composition that restores bile acid metabolism (Max BA) reduced body weight loss (FIG. 12A) and ALP levels (FIG. 12B) in response to DDC diet in germ-free Swiss albino mice.

As shown in FIG. 3, bacterial compositions can be designed to specifically restore microbial bile acid metabolism, reconstituting the bile acid of the mouse gut. We tested the efficacy of one such composition, Max BA (FIGS. 2 and 3), in protecting germ-free mice from liver disease in the DDC-diet induced model cholestasis. The Max BA composition was designed to restore all major bile acid metabolic activities including BSH, 7α-dehydroxylation and HSDH (FIG. 1). Germ-free mice were treated with the Max BA composition and allowed to colonize for 4 weeks. Colonized mice were then exposed to a DDC supplemented diet and monitored for development of liver disease compared to germ-free and conventional controls exposed to a DDC diet. Mice treated with the Max BA composition showed a slower rate of body weight loss and maintained lower serum ALP levels compared to uncolonized germ-free mice on the DDC diet (FIGS. 12A-12B), suggesting a slower progression of disease in the presence of the Max BA composition. Colonization with the designed bacterial composition was as effective as FMT treatment, and comparable to conventional mice, in decreasing the rate of liver disease progression with DDC treatment.

In view of this this discovery, in some embodiments, the invention relates to a bacterial composition that can restore levels of primary and secondary bile acids when administered to patients diagnosed with cholestatic disease, e.g., treatment with such a composition can result in primary and secondary bile acids present at levels within a range observed in healthy humans.

Colonization with mFMT Rescues Early Lethality in Germ-Free mdr2−/− C578116 Mice.

Tabiban et al. (Tabiban et al., Hepatol. 63:185-196, 2015) have previously shown that germ-free mdr2−/− mice in the FVB genetic background develop liver disease at a more rapid rate and with greater severity compared to conventional mdr2−/− mice. We chose to use C57Bl/6 mice with mdr2−/− deletion, a genetic background that has proved more sensitive to cholestatic disease in the DDC-diet induced cholestatic disease model (FIG. 11). Germ-free derivations of the mdr2−/− deletion mutant in the C57Bl/6 background resulted in early lethality, with surviving pups showing severe disease and lethality before they reached 4 weeks of age.

Given the demonstrated effectiveness of mouse-derived FMT in rescuing the susceptibility of germ-free mice in the DDC-diet induced cholestatic disease model (FIG. 10), we determined the effect of FMT treatment on survival of germ-free mdr2−/− mice in the C57Bl/6 genetic background. Foster moms were colonized with mouse FMT when pups were 2 weeks old, along with their bedding and cages. FMT colonization resulted in a 100% survival rate in treated mdr2−/− pups for greater than 12 weeks, while untreated pups that remained germ-free showed lethality within 4 weeks of age. The significant effect of colonization on survival of mdr2−/− germ-free mice further points to a role for the microbiome in ameliorating cholestatic liver disease. Testing compositions that lack bile acid activity (No BA) compared to ones reconstitute the majority of bile acid activity in the gut (Max BA) will provide insight into the specific role of bile acids in modulating the progression of cholestatic liver diseases.

Bile Acid Supplementation is Sufficient to Increase Resistance of Germ-Free Mice to DDC-Diet Induced Liver Disease We next explored the specific role of primary and secondary bile acid supplementation on progression of DDC-diet induced liver disease in the absence of a microbiome. Germ-free mice were fed diets supplemented with primary (CA+CDCA) or secondary (DCA+LCA) bile acids for 1 week and then exposed to DDC treatment. Bile acid supplementation was continued along with the DDC treatment to maintain signaling. Mice were monitored for rate of liver disease development based in body weight loss and serum biochemistry compared to germ-free and conventional controls on a DDC diet.

Figure 13:
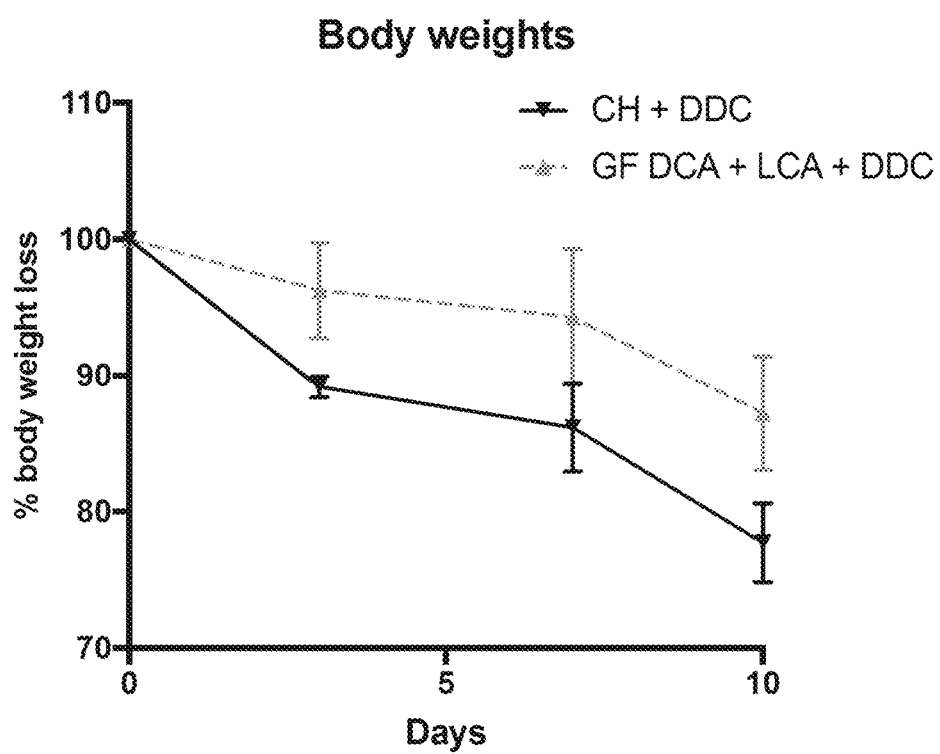
FIG. 13 demonstrates the beneficial effect of dietary supplementation with secondary bile acids (deoxycholic acid+lithocholic acid) on susceptibility to DDC-diet induced cholestatic disease. Germ-free Swiss albino mice on a DCA+LCA supplemented diet show a decreased rate of body weight loss compared to untreated germ-free mice on when exposed to the DDC diet.

At 7 days post DDC exposure, preliminary body weight analysis showed mice fed a DCA+LCA supplemented diet have a significantly slower rate of body weight loss compared to conventional mice on the DDC diet (FIG. 13). Mice on the DCA+LCA supplemented diet show an average of 87% body weight loss compared to 77% in conventional mice on the DDC diet. This also constitutes a significant improvement over the rate of body weight loss in the more susceptible germ-free mice on DDC. This indicates a significant role for secondary bile acid signaling in modulating susceptibility to liver disease, even in the absence of a microbiome. A composition that mimics these effects by specifically restoring DCA and LCA levels in the gut could significantly decrease the progression of liver disease. Ongoing analyses will assess continuing effects of the DCA+LCA diet as well as a diet supplemented with the primary bile acids, cholic acid and chenodeoxycholic acid.

In view of this discovery, in some embodiments, the invention relates to a bacterial composition that can increase DCA and LCA levels and/or cholic acid if administered to patients diagnosed with cholestatic disease.

Microbial Bile Acid Activity Contributes to Resistance Against DDC-Diet Induced Cholestatic Liver Disease To determine if the ability to restore secondary bile acid metabolism is necessary for the beneficial effects of a microbiome on susceptibility to liver disease, mice are treated with a designed composition composed of bacterial strains that lack all microbial bile acid activity (No BA, FIG. 1). This composition is unable to modify bile acids in the gut, and colonized mice will retain the same bile acid composition as germ-free mice. In these experiments, mice are treated with either the No BA composition, the Max BA composition (that restores 2° bile acid metabolism), or with a mouse derived FMT and allowed to colonize for 4 weeks. Colonized mice are placed on a DDC-supplement diet and development of liver disease is monitored based on body weight loss and serum biochemistry. A more rapid progression of disease in No BA colonized mice compared to the MaxBA or FMT mice would suggest a role for the production of primary and secondary bile acids by the microbiome resistance to cholestatic liver disease.

Example 5: Use of Gene Homology Searching Methods to Identify Strains Having Bile Acid Metabolism Activity Two examples of gene homology searching methods that can be used to identify strains with the potential for bile acid metabolic activity based on a strain's whole genome sequence are described as follows. In one method, the protein-coding regions from a strain's whole genome sequence is pairwise compared to a database of known characterized proteins that catalyze the desired bile acid activity with BLASTp; strains containing a protein with sufficient similarity to any of the proteins in the database are identified as putatively possessing the desired bile acid activity. In a second method, the protein-coding regions from a strain's whole genome sequence are compared to a profile hidden Markov model (HMM) derived from a multiple sequence alignment of known characterized proteins that catalyze the desired bile acid activity; strains containing a protein with sufficient similarity to the profile HMM can be identified as putatively possessing the desired bile acid activity. The details of the sequence database, profile HMM, and appropriate similarity cutoffs differ across the bile acid activities being queried, which are described below.

Figure 14:
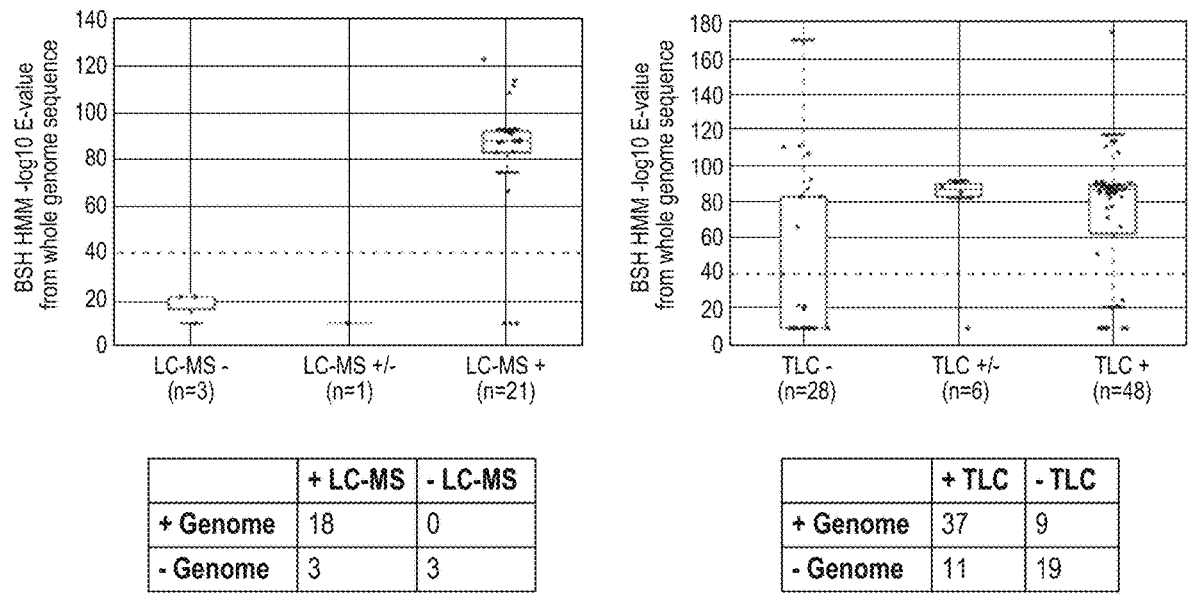
FIG. 14 is a set of graphs and tables showing the results of comparing bioinformatic prediction of BSH activity to in vitro assayed activity.

FIG. 14 shows the results of comparing bioinformatic prediction of BSH activity to in vitro assayed activity. All strains that have both been screened in vitro and have whole genome sequences available are considered. The left plot considers strains screened in vitro by LC-MS whereas the right plot considers strains that have been screened by TLC. Both plots show the e-value of the most significant alignment to the BSH HMM in that strain's genome. The significance of the genomic alignment significantly correlates with the results of the in vitro screen (Mann-Whitney U test; p=0.02 for LC-MS, p=0.0005 for TLC). A cutoff of e-value=1e-40 can be used to predict which strains will or will not have BSH activity (dotted line); the resulting confusion matrix for this classification cutoff is shown (for the LC-MS assay sensitivity=0.86, specificity=0.5, accuracy=0.88, p=0.01; for the TLC assay sensitivity=0.77, specificity=0.63, accuracy=0.74, p=0.0002). Note that due to the lower sensitivity of the TLC assay itself, the false positive rate of the genomic prediction may be overestimated. Furthermore, due to the low number of true negatives in the LC-MS assay, the specificity of the genomic predictions may be underestimated.

Figure 15:
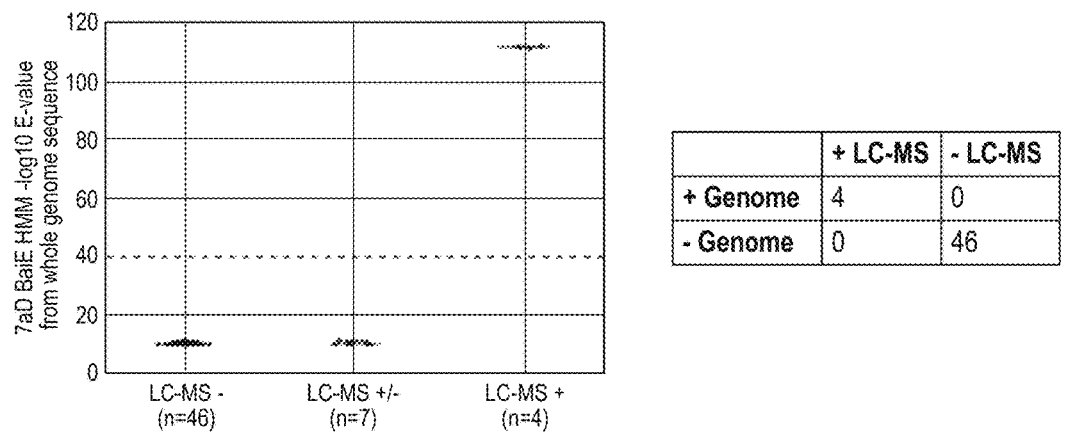
FIG. 15 is a graph and table showing the results of comparing bioinformatics prediction of 7α-dehydroxylation activity to in vitro assayed activity.

FIG. 15 shows the results of comparing bioinformatic prediction of 7α-dehydroxylation activity to in vitro assayed activity. All strains that have both been screened in vitro and have whole genome sequences available are considered. The box plot considers strains screened in vitro by LC-MS (none were screened by TLC). Both plots show the e-value of the most significant alignment to the BaiE HMM in that strain's genome. The significance of the genomic alignment significantly correlates with the results of the in vitro screen (Mann-Whitney U test; p<1e-8). A cutoff of e-value=1e-40 can be used to predict which strains will or will not have 7α-dehydroxylation activity (dotted line); the resulting confusion matrix for this classification cutoff is shown (sensitivity=1.0, specificity=1.0, accuracy=1.0, p<1e-5). Note that due to the low number of true positives, the true sensitivity, specificity and accuracy may be likely overestimated.

Other embodiments are within the scope of the following claims.

SEQUENCE LISTING (311 sequences)

SEQ ID NO: 1 - DNA, 1532 bp, Artificial Sequence
  Abiotrophia_defectiva
atgagagtttgatcctggctcaggatgaacgctggcggcgtgcctaacacatgcaagtcgaacggagattacggacggaagttttcggatggaagcctgtaattcttagtggcggacgggtgagtaacgcgtgggcaacctgccctatacagggggatagcagctggaaacggctggtaagaccgcataagtcggttaaatcgcatgatttgatcgggaaatgagcaatcaggtataggatgggcccgcgtccgattagccagttggcagggtaaaagcctaccaaagcgacgatcggtagccggactgagaggtcggacggccacattgggactgagacacggcccaaactcctacgggaggcagcagtgggggatattgcacaatggaggaaactctgatgcagcgacgccgcgtgagtgaagaagtatttcggtatgtaaagctctatcagcagggaagatgatgacggtacctgactaagaagccccggctaactacgcgccagcagccgcggtaatacgtagggggcaagcgttatccggatttactgggtgtaaagggagcgcaggcggttttgcaagttgagagtggaagcagggggctcaaccccctgactgctcccaaaactgtaaaacttgagtatgggagaggcaggcggaattcctagtgtagcggtgaaatgcttagatattaggaagaacaccggtggcgaaggcggcctgctggaccaaaactgacgctgaggctcgaaagcgtgggtagcaaacaggattagataccctggtagtccacgctgtaaacgatgaatactaggtgctgggatgcataagcatttcggtgccgtcgcaaacgcattaagtattccacctggggagtacgttcgcaagaatgaaactcaaaggaattgacggggacccgcacaagcggtggagcatgtggtttaattcgacgcaacgcgaagaaccttacccggtcttgagatcctcctgaatactgagtaatgtcagtagtccttcgggacaggagagacaggtggtgcatggttgtcgtcagctcgtgtcgtgagatgttgggttaagtcccgcaacgagcgcaacccctatttttagtagccagcggttcggccgggcactctaaagagactgccgaggataactcggaggaaggcggggatgacgtcaaatcatcatgccccttatgaccggggctacacacgtgctacaatggcagttacagagggaagcgaaggcgtgagccggagcaaatctcagaaaggctgcctcagttcggattgtagtctgcaactcgactacatgaagctggaatcgctagtaatcgcgaatcagaatgtcgcggtgaatacgttcccgggtcttgtacacaccgcccgtcacaccatgggagtcggaaatgcccgaagtcagtggcctaaccgtaagggaggagctgccgaaggcaggtctggtgactggggtgaagtcgtaacaaggtagccgtatcggaaggtgcggctggatcacctcctttct

SEQ ID NO: 2 - DNA, 1328 bp, Artificial Sequence
  Abiotrophia_sp_oral_clone_P4PA
gacgaacgctggcggtgtgcctaatacatgcaagtcgaacgagtggcgaacgggtgagtaacacgtgggtaacctacctcatagtgggggataacagtcggaaacgactgctaataccgcatagggaaagtcgctaagagatggacccgcggtgcattagctggttggtagggtaaaggcctaccaaggcgatgatgcatagccgacctgagagggtgatcggccacattgggactgagactcggcccagactcctacgggaggcagcagtagggaatcttccgcaatggacgcaagtctgacggagcaacgccgcgtgagtgaagaaggtcttcggatcgtaaagctctgttgttggagaagatgacggtatctaaccggaaagccacggctaactacgtgccagcagccgcggtaatacgtaggtggcgagcgttgtccggatttattgggcgtaaagggagtgtaggcggtcttttaagtctgatgtgaaagcccacggctcaaccgtggagggtcattggaaactgggagacttgagtgcagaagaggagagcggaattccatgtgtagcggtgaaatgcgtagatatatggaggaacaccagtggcgaaggcggctctctggtctgactgacgctgaggctcgaaagcgtggggagcaaacaggattagataccctggtagtccacgccgtaaacgatgagtgctaagtgttggagcttcagtgctggagttaacgcaataagcactccgcctggggagtacggccgcaaggctgaaactcaaaggaattgacggggacccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaacccctataactagttgccagcatggggactctagttagactgccggtgacaaaccggaggaaggtggggatgacgtcaaatcatcatgccccttatgacctgggctacacacgtgctacaatggatggcaacgagcagcgaactcgcgagggtaagcgaatctctaccattctcagttcggatgtagtctgcaacccgactacagaagccggaatcgctagtaatcgcggatcagcacgccgcggtgaatacgttcccgggtcttgtacacaccgcccgtcacaccacgagagtttgtaacacccgaagccggtgcctagggagccgtcgaaggtgggatagatgattggggtgaagtcgtaacaaggtagccgtatcggaaggtgc

SEQ ID NO: 3 - DNA, 1488 bp, Artificial Sequence
  Aerococcus_sanguinicola
ctcaggacgaacgctggcggcatgcctaatacatgcaagtcgagcgaaccgacgaagtgcttgcacttctgacgttagcggcggacgggtgagtaacacgtaaggaacctacctatgagcgggggacaacatccggaaacgggtgctaataccgcatagtaatttgtcaggcatctgacaaattggaaagacggcttttgctgtcactcatagatggtcttgcggtgcattagctagttggtgggataaaagcttaccaaggccatgatgcatagccgacctgagagggtaatcggccacactgggactgagacacggcccagactcctacgggaggcagcagtagggaatcttccgcaatgggcgcaagcctgacggagcaatgccgcgtgagtgaagaaggttttcggatcgtaaaactctgttgtaagagaagaacaaattgtagagtaactgctacagtcttgacggtatcttaccagaaagccacggctaactacgtgccagcagccgcggtaatacgtaggtggcaagcgttgtccggatttattgggcgtaaagggagcgcaggtggtttcttaagtctgatgtgaaagcccacggcttaaccgtggagggtcattggaaactgggaaacttgagtgcagaagaggaaagtggaactccatgtgtagcggtggaatgcgtagatatatggaagaacaccagtggcgaaggcgactttctggtctgtaactgacactgaggctcgaaagcgtgggtagcaaacaggattagataccctggtagtccacgccgtaaacgatgagtgctaggtgttggagggtttccgcccttcagtgccgcagttaacgcattaagcactccgcctggggagtacggccgcaaggctgaaactcaaaggaattgacggggacccgcacaagcggtggagcatgtggtttaattcgaagcaacgcgaagaaccttaccaagtcttgacatcctttgaccactctagagatagagctttcccttcggggacaaagtgacaggtggtgcatggttgtcgtcagctcgtgtcgtgagatgttgggttaagtcccgcaacgagcgcaacccttattgttagttgccagcatttagttgggcactctagcgagactgccggtgacaaaccggaggaaggcggggatgacgtcaaatcatcatgccccttatgacttgggctacacacgtgctacaatggatggtacaacgggctgcgaactcgcgagagtcagcgaatcccttaaagccattctcagttcggattgcaggctgcaactcgcctgcatgaagccggaatcgctagtaatcgcggatcagcacgccgcggtgaatacgttcccgggtcttgtacacaccgcccgtcacaccacgagagtttgtaacacccgaagtcggtgaggtaaccttttggagccagccgccgaaggtgggacagatgattggggtgaagtcgtaaca

SEQ ID NO: 4 - DNA, 1546 bp, Artificial Sequence
  Aerococcus_urinae
atgagagtttgatcctggctcaggacgaacgctggcggcgtgcctaatacatgcaagtcgagcgaaccgaagaagtgcttgcacttctgacgttagcggcggacgggtgagtaacacgtaaggaacctaccgataagcgggggacaacatccggaaacgggtgctaataccgcataggaaacaccacctcatggtggtgtttggaaagacggctttgctgtcacttatcgatggccttgcggtgcattagctcgttggtggggtaacggcctaccaaggcaatgatgcatagccgacctgagagggtaatcggccacattgggactgagacacggcccaaactcctacgggaggcagcagtagggaatcttccgcaatgggcgcaagcctgacggagcaacgccgcgtgagtgaagaaggttttcggatcgtaaagctctgttgtaagagaagaacaaattggagagtaactgctccagtcttgacggtatcttaccagaaagccacggctaactacgtgccagcagccgcggtaatacgtaggtggcaagcgttgtccggatttattgggcgtaaagggggcgcaggcggtttcttaagtctgatgtgaaagcccacggcttaaccgtggaagtgcattggaaactggggaacttgagtacagaagaggaaagtggaactccatgtgtagcggtggaatgcgtagatatatggaagaacaccagtggcgaaggcgactttctggtctgtcactgacgctgaggcccgaaagcgtgggtagcaaacaggattagataccctggtagtccacgccgtaaacgatgagtgctaggtgttggagggtttccacccttcagtgccggagttaacgcattaagcactccgcctggggagtacggccgcaaggctgaaactcaaaggaattgacggggacccgcacaagcggtggagcatgtggtttaattcgaagcaacgcgaagaaccttaccaagtcttgacatcctttgaccactctagagatagagctttcccttcggggacaaagtgacaggtggtgcatggttgtcgtcagctcgtgtcgtgagatgttgggttaagtcccgcaacgagcgcaacccttattgttagttgccagcattgagttgggcactctagcgagactgccggtgacaaaccggaggaaggcggggatgacgtcaaatcatcatgccccttatgacttgggctacacacgtgctacaatggatggtacaacgagcagcgaccttgtgaaagcaagcgaatctcttaaagccattctcagttcggattgtagtctgcaactcgactacatgaagccggaatcgctagtaatcgcggatcagcacgccgcggtgaatacgttcccgggtcttgtacacaccgcccgtcacaccacgagagtttgtaacacctgaagtcggtgaggtaacctttggagccagccgccgaaggtgggacagatgattggggtgaagtcgtaacaaggtagccgtaggtgaacctgcggctggatcacctcctttct

SEQ ID NO: 5 - DNA, 1419 bp, Artificial Sequence
  Aerococcus_urinaeequi
  misc_feature (1092)..(1092): n is a, c, g, or t
acatgcaagtcgagcgaacagatgaagtgcttgcacttctgacgttagcggcgaacgggtgagtaacacgtaaggaatctacctataagcgggggataacattcggaaacgggtgctaataccgcataatatcttcttccgcatggaaggagattgaaagacggctctgctgtcacttatagatgaccttgcggtgcattagttagttggtggggtaacggcctaccaagacgatgatgcatagccgacctgagagggtgatcggccacattgggactgagacacggcccaaactcctacgggaggcagcagtagggaatcttccgcaatgggcgaaagcctgacggagcaatgccgcgtgagtgaagaaggccttcgggtcgtaaaactctgttataagagaagaacaaattgtagagtaactgctacagtcttgacggtatcttatcagaaagccacggctaactacgtgccagcagccgcggtaatacgtaggtggcaagcgttgtccggatttattgggcgtaaagggagcgcaggtggtttcttaagtctgatgtgaaagcccacggcttaaccgtggagggtcattggaaactgggaaacttgagtacagaagaggaatgtggaactccatgtgtagcggtggaatgcgtagatatatggaagaacaccagtggcgaaggcgacattctggtctgttactgacactgaggctcgaaagcgtggggagcaaacaggattagataccctggtagtccacgccgtaaacgatgagtgctaggtgttggagggtttccgcccttcagtgccgcagttaacgcattaagcactccgcctggggagtacgaccgcaaggttgaaactcaaaggaattgacggggacccgcacaagcggtggagcatgtggtttaattcgaagcaacgcgaagaaccttaccaagtcttgacatcctttgaccaccctagagatagggctttcccttcggggacaaagtgacaggtggtgcatggttgtcgtcagctcgtgtcgtgagatgttgggttaagtcccgcaacgagcgcaacccctattattagttgccagcattnagttgggcactctaatgagactgccggtgacaaaccggaggaaggtggggatgacgtcaaatcagcatgccccttatgacttgggctacacacgtgctacaatggatggtacaacgagtcgcaaacccgcgagggcaagcaaatctcttaaagccattctcagttcggattgcaggctgcaactcgcctgcatgaagccggaatcgctagtaatcgtggatcagcacgccacggtgaatacgttcccgggtcttgtacacaccgcccgtcacaccacgagagtttgtaacacccgaagtcggtgaggtaacctttatggagccagcc

SEQ ID NO: 6 - DNA, 1548 bp, Artificial Sequence
  Aerococcus_viridans
atgagagtttgatcctggctcaggacgaacgctggcggcatgcctaatacatgcaagtcgagcgaacagatgaagtgcttgcacttctgacgttagcggcgaacgggtgagtaacacgtaaggaatctacctataagcgggggataacattcggaaacgggtgctaataccgcataatattttcttccgcatggaagaagattgaaagacggctctgctgtcacttatagatgaccttgcggtgcattagttagttggtggggtaatggcctaccaagacgatgatgcatagccgacctgagagggtgatcggccacattgggactgagacacggcccaaactcctacgggaggcagcagtagggaatcttccgcaatgggcgaaagcctgacggagcaatgccgcgtgagtgaagaaggccttcgggtcgtaaaactctgttataagagaagaacaaattgtagagtaactgctacagtcttgacggtatcttatcagaaagccacggctaactacgtgccagcagccgcggtaatacgtaggtggcaagcgttgtccggatttattgggcgtaaagggagcgcaggtggtttcttaagtctgatgtgaaagcccacggcttaaccgtggagggtcattggaaactgggaaacttgagtacagaagaggaatgtggaactccatgtgtagcggtggaatgcgtagatatatggaagaacaccagtggcgaaggcgacattctggtctgttactgacactgaggctcgaaagcgtggggagcaaacaggattagataccctggtagtccacgccgtaaacgatgagtgctaggtgttggagggtttccgcccttcagtgccgcagttaacgcattaagcactccgcctggggagtacgaccgcaaggttgaaactcaaaggaattgacggggacccgcacaagcggtggagcatgtggtttaattcgaagcaacgcgaagaaccttaccaagtcttgacatcctttgaccaccctagagatagggctttcccttcggggacaaagtgacaggtggtgcatggttgtcgtcagctcgtgtcgtgagatgttgggttaagtcccgcaacgagcgcaacccctattattagttgccagcatttagttgggcactctaatgagactgccggtgacaaaccggaggaaggtggggatgacgtcaaatcagcatgccccttatgacttgggctacacacgtgctacaatggatggtacaacgagtcgcaaacccgcgagggcaagcaaatctcttaaagccattctcagttcggattgcaggctgcaactcgcctgcatgaagccggaatcgctagtaatcgtggatcagcacgccacggtgaatacgttcccgggtcttgtacacaccgcccgtcacaccacgagagtttgtaacacccgaagtcggtgaggtaacctttatggagccagccgccgaaggtgggacagatgattggggtgaagtcgtaacaaggtagccgtatcggaaggtgcggctggatcacctcctttct

SEQ ID NO: 7 - DNA, 1446 bp, Artificial Sequence
  Alistipes_finegoldii
gatgaacgctagcggcaggcttaacacatgcaagtcgaggggcagcacgaggtagcaatactttggtggcgaccggcgcacgggtgcgtaacgcgtatgcaacctacctttaacaggggcataacactgagaaattggtactaattccccataacattcgagaaggcatcttcttgggttaaaaactccggtggttaaagatgggcatgcgttgtattagctagttggtgaggtaacggctcaccaaggcaacgatacatagggggactgagaggttaaccccccacattggtactgagacacggaccaaactcctacgggaggcagcagtgaggaatattggtcaatggacgcaagtctgaaccagccatgccgcgtgcaggaagacggctctatgagttgtaaactgcttttgtactagggtaaacgctcttacgtgtaggagcctgaaagtatagtacgaataaggatcggctaactccgtgccagcagccgcggtaatacggaggatccaagcgttatccggatttattgggtttaaagggtgcgtaggcggtttgataagttagaggtgaaataccggggctcaactccggaactgcctctaatactgttgaactagagagtagttgcggtaggcggaatgtatggtgtagcggtgaaatgcttagagatcatacagaacaccgattgcgaaggcagcttaccaaactatatctgacgttgaggcacgaaagcgtggggagcaaacaggattagataccctggtagtccacgcagtaaacgatgataactcgttgtcggcgatacacagtcggtgactaagcgaaagcgataagttatccacctggggagtacgttcgcaagaatgaaactcaaaggaattgacgggggcccgcacaagcggaggaacatgtggtttaattcgatgatacgcgaggaaccttacccgggcttgaaagttagtgacgattctggaaacaggatttcccttcggggcacgaaactaggtgctgcatggttgtcgtcagctcgtgccgtgaggtgtcgggttaagtcccataacgagcgcaacccctaccgttagttgccatcaggtcaagctgggcactctggcgggactgccggtgtaagccgagaggaaggtggggatgacgtcaaatcagcacggcccttacgtccggggctacacacgtgttacaatggtaggtacagagggccgctaccccgcgaggggatgccaatctcgaaagcctatctcagttcggatcggaggctgaaacccgcctccgtgaagttggattcgctagtaatcgcgcatcagccatggcgcggtgaatacgttcccgggccttgtacacaccgcccgtcaagccatggaagctgggggtgcctgaagttcgtgaccgcaaggagcgacctagggcaaaaccggtgactggggct

SEQ ID NO: 8 - DNA, 1495 bp, Artificial Sequence
  Bacteroides_acidifaciens
tatcatggctcaagatgaacgctagctacaggcttaacacatgcaagtcgaggggcagcatgaaagtttgcttgcaaacttttgatggcgaccggcgcacgggtgagtaacacgtatccaacctgcctcatactcggggatagcctttcgaaagaaagattaatacccgatgtcatagtcctaccgcatgatgggattattaaagaatttcggtatgggatggggatgcgttccattagttagttggcggggtaacggcccaccaagacaacgatggataggggttctgagaggaaggtcccccacattggaactgagacacggtccaaactctacgggaggcagcagtgaggaatattggtcaatggacgagagtctgaaccagccaagtagcgtgaaggatgactgccctatgggttgtaaacttcttttatatgggaataaaatgttccacgtgtgggattttgtatgtaccatatgaataaggatcggctaactccgtgccagcagccgcggtaatacggaggatccgagcgttatccggatttattgggtttaaagggagcgtaggtggattgttaagtcagttgtgaaagtttgcggctcaaccgtaaaattgcagttgaaactggcagtcttgagtacagtagaggtgggcggaattcgtggtgtagcggtgaaatgcttagatatcacgaagaactccgattgcgaaggcagctcactggactgcaactgacactgaggctcgaaagtgtgggtatcaaacaggattagataccctggtagtccacacagtaaacgatgaatactcgctgtttgcgatatacggcaagcggccaagcgaaagcattaagtattccacctggggagtacgccggcaacggtgaaactcaaaggaattgacgggggccgcacaagcggaggaacatgtggtttaattcgatgatacgcgaggaaccttacccgggcttaaattgcacctgaataatgtggaaacatgttagccgtaaggcaggtgtgaaggtgctgcatggttgtcgtcagctcgtgccgtgaggtgtcggcttaagtgccataacgagcgcaacccttatcttcagttactaacaggtcatgctgaggactctggagagactgccgtcgtaagatgtgaggaaggtggggatgacgtcaaatcagcacggcccttacgtccggggctacacacgtgttacaatgggaggtacagaaggccgctacctggcgacaggatgccaatccccaaaacctctctcagttcggatcgaagtctgcaacccgacttcgtgaagctggattcgctagtaatcgcgcatcagccatggcgcggtgaatacgttcccgggccttgtacacaccgcccgtcaagccatgaaagccgggggtacctgaagtacgtaaccgcaagatcgtcctagggtaaaactggtaattggggctaagtcgtaacaaggtagccgtaccggaaggtgcg

SEQ ID NO: 9 - DNA, 1422 bp, Artificial Sequence
  Bacteroides_caccae
  misc_feature (179)..(181): n is a, c, g, or t
  misc_feature (901)..(901): n is a, c, g, or t
  misc_feature (1006)..(1006): n is a, c, g, or t
  misc_feature (1420)..(1420): n is a, c, g, or t
atgaacgctagctacaggcttaacacatgcaagtcgaggggcatcagtttgtttgcttgcaaacaaacgctggcgaccggcgcacgggtgagtaacacgtatccaacctacctcatactcggggatagcctttcgaaagaaagattaatatccgatagcatatatttcccgcatgggtnnnatattaaagaaattcggtatgagatggggatgcgttccattagtttgttgggggggtaacggcccaccaagactacgatggataggggttctgagaggaaggtcccccacattggaactgagacacggtccaaactcctacgggaggcagcagtgaggaatattggtcaatggacgcgagtctgaaccagccaagtagcgtgaaggatgactgccctatgggttgtaaacttcttttatatgggaataaagtggtccacgtgtggacttttgtatgtaccatatgaataaggatcggctaactccgtgccagcagccgcggtaatacggaggatccgagcgttatccggatttattgggtttaaagggagcgtaggcggattgttaagtcagttgtgaaagtttgcggctcaaccgtaaaattgcagttgatactggcagtcttgagtgcagtagaggtgggcggaattcgtggtgtagcggtgaaatgcttagatatcacgaagaactccgattgcgaaggcagctcactggagtgtaactgacgctgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggccngcacaagcggaggaacatgtggtttaattcgatgatacgcgaggaaccttacccgggcttaaattgcaaatgaattatggggaaacccatacgccgcaaggcatntgtgaaggtgctgcatggttgtcgtcagctcgtgccgtgaggtgtcggcttaagtgccataacgagcgcaacccttatcttcagttactaacaggtcatgctgaggactctggagagactgccgtcgtaagatgtgaggaaggtggggatgacgtcaaatcagcacggcccttacgtccggggctacacacgtgttacaatggggggtacagaaggcagctacctggtgacaggatgccaatcccaaaaacctctctcagttcggatcgaagtctgcaacccgacttcgtgaagctggattcgctagtaatcgcgcatcagccatggcgcggtgaatacgttcccgggccttgtacacaccgcccgtcaagccatgaaagccgggggtacctgaagtacgtaaccgcaaggagngt

SEQ ID NO: 10 - DNA, 1521 bp, Artificial Sequence
  Bacteroides_caccae
gtttgatcctggctcaggatgaacgctagctacaggcttaacacatgcaagtcgaggggcatcagtttggtttgcttgcaaaccaaagctggcgaccggcgcacgggtgagtaacacgtatccaacctacctcatactcggggatagcctttcgaaagaaagattaatatccgatggcatatatttcccgcatgggttttatattaaagaaattcggtatgagatggggatgcgttccattagtttgttgggggggtaacggcccaccaagactacgatggataggggttctgagaggaaggtcccccacattggaactgagacacggtccaaactcctacgggaggcagcagtgaggaatattggtcaatggacgcgagtctgaaccagccaagtagcgtgaaggatgactgccctatgggttgtaaacttcttttatatgggaataaagtggtccacgtgtggacttttgtatgtaccatatgaataaggatcggctaactccgtgccagcagccgcggtaatacggaggatccgagcgttatccggatttattgggtttaaagggagcgtaggcggattgttaagtcagttgtgaaagtttgcggctcaaccgtaaaattgcagttgatactggcagtcttgagtgcagtagaggtgggcggaattcgtggtgtagcggtgaaatgcttagatatcacgaagaactccgattgcgaaggcagctcactggagtgtaactgacgctgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcaaatgaattatggggaaacccatacgccgcaaggcatttgtgaaggtgctgcatggttgtcgtcagctcgtgccgtgaggtgtcggcttaagtgccataacgagcgcaacccttatcttcagttactaacaggtcatgctgaggactctggagagactgccgtcgtaagatgtgaggaaggtggggatgacgtcaaatcagcacggcccttacgtccggggctacacacgtgttacaatgaggggtacagaaggccgctacctggtgacaggatgccaatcccaaaaacctctctcagttcggatcgaagtctgcaacccgacttcgtgaagctggattcgctagtaatcgcgcatcagccatggcgcggtgaatacgttcccgggccttgtacacaccgcccgtcaagccatgaaagccgggggtacctgaagtacgtaaccgcaaggagcgtcctagggtaaaactggtaattggggctaagtcgtaacaaggtagccgtaccggaaggtgcggctggaacacctcctttct

SEQ ID NO: 11 - DNA, 1531 bp, Artificial Sequence
  Bacteroides_eggerthii
ttacaatgaagagtttgatcctggctcaggatgaacgctagctacaggcttaacacatgcaagtcgaggggcagcatgattgaagcttgcttcaatcgatggcgaccggcgcacgggtgagtaacacgtatccaacctgccgataactcggggatagcctttcgaaagaaagattaatacccgatagtatagtatttccgcatggtttcactattaaagaatttcggttatcgatggggatgcgttccattagatagttggcggggtaacggcccaccaagtcaacgatggataggggttctgagaggaaggtcccccacattggaactgagacacggtccaaactcctacgggaggcagcagtgaggaatattggtcaatggacgagagtctgaaccagccaagtagcgtgaaggatgactgccctatgggttgtaaacttcttttatacgggaataaagtggagtatgcatactcctttgtatgtaccgtatgaataaggatcggctaactccgtgccagcagccgcggtaatacggaggatccgagcgttatccggatttattgggtttaaagggagcgtaggcgggtgcttaagtcagttgtgaaagtttgcggctcaaccgtaaaattgcagttgatactgggtaccttgagtgcagcataggtaggcggaattcgtggtgtagcggtgaaatgcttagatatcacgaagaactccgattgcgaaggcagcttactggactgtaactgacgctgatgctcgaaagtgtgggtatcaaacaggattagataccctggtagtccacacagtaaacgatgaatactcgctgttggcgatacacagtcagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcagtggaatgtagtggaaacattacagccttcgggccgctgtgaaggtgctgcatggttgtcgtcagctcgtgccgtgaggtgtcggcttaagtgccataacgagcgcaacccttatctatagttactatcaggtcatgctgaggactctatggagactgccgtcgtaagatgtgaggaaggtggggatgacgtcaaatcagcacggcccttacgtccggggctacacacgtgttacaatggggggtacagaaggcagctacctggcgacaggatgctaatccctaaaacctctctcagttcggattggagtctgcaacccgactccatgaagctggattcgctagtaatcgcgcatcagccacggcgcggtgaatacgttcccgggccttgtacacaccgcccgtcaagccatgaaagccgggggtacctgaagtacgtaaccgcaaggagcgtcctagggtaaaactggtgattggggctaagtcgtaacaaggtagccgtaccggaaggtgcggctggaacacctcctttct

SEQ ID NO: 12 - DNA, 1527 bp, Artificial Sequence
  Bacteroides_eggerthii
tacaatgaagagtttgatcctggctcaggatgaacgctagctacaggcttaacacatgcaagtcgaggggcagcatgattgaagcttgcttcaatcgatggcgaccggcgcacgggtgagtaacacgtatccaacctgccgataactcggggatagcctttcgaaagaaagattaatacccgatagtatagtttttccgcatggtttcactattaaagaatttcggttatcgatggggatgcgttccattagatagttggcggggtaacggcccaccaagtcaacgatggataggggttctgagaggaaggtcccccacattggaactgagacacggtccaaactcctacgggaggcagcagtgaggaatattggtcaatggacgagagtctgaaccagccaagtagcgtgaaggatgactgccctatgggttgtaaacttcttttatacgggaataaagtggagtatgcatactcctttgtatgtaccgtatgaataaggatcggctaactccgtgccagcagccgcggtaatacggaggatccgagcgttatccggatttattgggtttaaagggagcgtaggcgggtgcttaagtcagttgtgaaagtttgcggctcaaccgtaaaattgcagttgatactgggcgccttgagtgcagcataggtaggcggaattcgtggtgtagcggtgaaatgcttagatatcacgaagaactccgattgcgaaggcagcttactggactgtaactgacgctgatgctcgaaagtgtgggtatcaaacaggattagataccctggtagtccacacagtaaacgatgaatactcgctgttggcgatacacagtcagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcagcggaatgtagtggaaacattacagccttcgggccgctgtgaaggtgctgcatggttgtcgtcagctcgtgccgtgaggtgtcggcttaagtgccataacgagcgcaacccttatctatagttactatcaggtcatgctgaggactctatggagactgccgtcgtaagatgtgaggaaggtggggatgacgtcaaatcagcacggcccttacgtccggggctacacacgtgttacaatggggggtacagaaggcagctacctggcgacaggatgctaatcccgaaaacctctctcagttcggattggagtctgcaacccgactccatgaagctggattcgctagtaatcgcgcatcagccacggcgcggtgaatacgttcccgggccttgtacacaccgcccgtcaagccatgaaagccgggggtacctgaagtacgtaaccgcaaggagcgtcctagggtaaaactggtgattggggctaagtcgtaacaaggtagccgtaccggaaggtgcggctggaacacctcctt

SEQ ID NO: 13 - DNA, 1458 bp, Artificial Sequence
  Bacteroides_faecis
gatgaacgctagctacaggcttaacacatgcaagtcgaggggcagcattccagtttgcttgcaaactggagatggcgaccggcgcacgggtgagtaacacgtatccaacctgccgataactcggggatagcctttcgaaagaaagattaatacccgatggcataatagaaccgcatggtttgattattaaagaatttcggttatcgatggggatgcgttccattaggcagttggtggggtaacggcccaccaaaccttcgatggataggggttctgagaggaaggtcccccacattggaactgagacacggtccaaactcctacgggaggcagcagtgaggaatattggtcaatggacgagagtctgaaccagccaagtagcgtgaaggatgactgccctatgggttgtaaacttcttttatatgggaataaagtgatccacgtgtggatttttgtatgtaccatatgaataaggatcggctaactccgtgccagcagccgcggtaatacggaggatccgagcgttatccggatttattgggtttaaagggagcgtaggtggacagttaagtcagttgtgaaagtttgcggctcaaccgtaaaattgcagttgatactggctgtcttgagtacagtagaggtgggcggaattcgtggtgtagcggtgaaatgcttagatatcacgaagaactccgattgcgaaggcagctcactggactgcaactgacactgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcatttgaatatattggaaacagtatagtcgtaagrcaaatgtgaaggtgctgcatggttgtcgtcagctcgtgccgtgaggtgtcggcttaagtgccataacgagcgcaacccttatcttyagttactaacaggtcatgctgaggactctggagagactgccgtcgtaagatgtgaggaaggtggggatgacgtcaaatcagcacggcccttacgtccggggctacacacgtgttacaatggggggtacagaaggycgctacctggtgacaggatgctaatcccaaaagcctctctcagttcggatcgaagtctgcaacccgacttcgtgaagctggattcgctagtaatcgcgcatcagccatggcgcggtgaatacgttcccgggccttgtacacaccgcccgtcaagccatgaaagccgggggtacctgaagtacgtaaccgcaaggagcgtcctagggtaaaactggtaattggggctaagtcgt

SEQ ID NO: 14 - DNA, 1323 bp, Artificial Sequence
  Bacteroides_finegoldii
gagtttgatcctggctcaggatgaacgctagctacaggcttaacacatgcaagtcgagggaccggcgcacgggtgagtaacacgtatccaacctgccgataactcagggatagcctttcgaaagaaagattaatacctgatggctaaagtcggttatcgatggggatgcgttccattagtttgttggcggggtaacggcccaccaagacagcgatggataggggttctgagaggaaggtcccccacattggaactgagacacggtccaaactcctacgggaggcagcagtgaggaatattggtcaatggacgggagtctgaaccagccaagtagcgtgaaggatgactgcctatgggttgtaaacttcttttatacgggaatatgtatgtaccgtatgaataaggatcggctaactccgtgccagcagccgcggtaatacggaggatccgagcgttatccggatttattgggtttaaagggagcgtaggtggattgttaagtcagttgtgaaagtttgcggctcaaccgtaaaattgcagttgatactggcagtcttgagtacagtagaggtgggcggaattcgtggtgtagcggtgaaatgcttagatatcacgaagaactccgattgcgaaggcagctcactggactgactgacactgatgctcgaaagtgtgggtatcaaacaggattagataccctggtagtccacacagtaaacgatgaatactcgctgtttgcgtaagcggccaagcgaaagcgttaagtattccacctggggagtacgccggcacggtgaaactcaaaggaattgacgggggcccgcacaagcggaggaacatgtggtttaattcgatgatacgcgaggaaccttacccgggcttaaattgtgaaggtgctgcatggttgtcgtcagctcgtgccgtgaggtgtcggcttaagtgccataacgagcgcaacccttatcttcagttactaacagctgaggactctggagagactgccgtcgtaagatggaggaaggtggggatgacgtcaaatcagcacggcccttacgtccggggctacacacgtgttacaatggggggcagaaggcagctacctggcgacaggatgccaatcccgcctctctcagttcggacgaagtctgcaacccgacttcggaagctggattcgctagtaatcgcgcatcagccatggcgcggtgaatacgttcccgggccttgtacacaccgcccgtcaagccatgaaagccgggggtacctgaagtacgtagcgtcctagggtaaaactggtaattggggctaagtcgtaacaaggtaacc

SEQ ID NO: 15 - DNA, 1485 bp, Artificial Sequence
  Bacteroides_finegoldii
agagtttgatcctggctcaggatgaacgctagctacaggcttaacacatgcaagtcgaggggcagcattttagtttgcttgcaaactaaagatggcgaccggcgcacgggtgagtaacacgtatccaacctgccgataactcagggatagcctttcgaaagaaagattaataccggatggcataggattgtcgcatgatgatcctattaaagaatttcggttatcgatggggatgcgttccattaggcagttggtgaggtaacggctcaccaaaccttcgatggataggggttctgagaggaaggtcccccacattggaactgagacacggtccaaactcctacgggaggcagcagtgaggaatattggtcaatggacgggagtctgaaccagccaagtagcgtgaaggatgactgccctatgggttgtaaacttcttttatacgggaataaagtgatccacgtgtggatttttgtatgtaccgtatgaataaggatcggctaactccgtgccagcagccgcggtaatacggaggatccgagcgttatccggatttattgggtttaaagggagcgtaggtggattgttaagtcagttgtgaaagtttgcggctcaaccgtaaaattgcagttgatactggcagtcttgagtacagtagaggtgggcggaattcgtggtgtagcggtgaaatgcttagatatcacgaagaactccgattgcgaaggcagctcactggactgcaactgacactgatgctcgaaagtgtgggtatcaaacaggattagataccctggtagtccacacagtaaacgatgaatactcgctgtttgcgatatacggtaagcggccaagcgaaagcgttaagtattccacctggggagtacgccggcaacggtgaaactcaaaggaattgacgggggcccgcacaagcggaggaacatgtggtttaattcgatgatacgcgaggaaccttacccgggcttaaattacatttgaataatctggaaacaggttagccgtaaggcaaatgtgaaggtgctgcatggttgtcgtcagctcgtgccgtgaggtgtcggcttaagtgccataacgagcgcaacccttatcttcagttactaacaggtcatgctgaggactctggagagactgccgtcgtaagatgtgaggaaggtggggatgacgtcaaatcagcacggcccttacgtccggggctacacacgtgttacaatggggggtacagaaggcagctacctggtgacaggatgctaatcccaaaaacctctctcagttcggatcgaagtctgcaacccgacttcgtgaagctggattcgctagtaatcgcgcatcagccatggcgcggtgaatacgttcccgggccttgtacacaccgcccgtcaagccatgaaagccgggggtacctgaagtacgttacccagagcgttctaaggtaaaatggtattggggctaagtcgtaacaaggtaacc

SEQ ID NO: 16 - DNA, 1322 bp, Artificial Sequence
  Bacteroides_finegoldii
gagtttgatcctggctcaggatgaacgctagctacaggcttaacacatgcaagtcgagggaccggcgcacgggtgagtaacacgtatccaacctgccgataactcagggatagcctttcgaaagaaagattaataccggatggctaaagtcggttatcgatggggatgcgttccattaggcagttggtgaggtaacggctcaccaaaccttcgatggataggggttctgagaggaaggtcccccacattggaactgagacacggtccaaactcctacgggaggcagcagtgaggaatattggtcaatggacgggagtctgaaccagccaagtagcgtgaaggatgactgcctatgggttgtaaacttcttttatacgggaatatgtatgtaccgtatgaataaggatcggctaactccgtgccagcagccgcggtaatacggaggatccgagcgttatccggatttattgggtttaaagggagcgtaggtggattgttaagtcagttgtgaaagtttgcggctcaaccgtaaaattgcagttgatactggcagtcttgagtacagtagaggtgggcggaattcgtggtgtagcggtgaaatgcttagatatcacgaagaactccgattgcgaaggcagctcactggactgactgacactgatgctcgaaagtgtgggtatcaaacaggattagataccctggtagtccacacagtaaacgatgaatactcgctgtttgcgtaagcggccaagcgaaagcgttaagtattccacctggggagtacgccggcacggtgaaactcaaaggaattgacgggggcccgcacaagcggaggaacatgtggtttaattcgatgatacgcgaggaaccttacccgggcttaaattatgaagtgctgcatggttgtcgtcagctcgtgccgtgaggtgtcggcttaagtgccataacgagcgcaacccttatcttcagttactaacagctgaggactctggagagactgccgtcgtaagatggaggaaggtggggatgacgtcaaatcagcacggcccttacgtccggggctacacacgtgttacaatggggggcagaaggcagctacctggtgacaggatgctaatcccacctctctcagttcggacgaagtctgcaacccgacttcggaagctggattcgctagtaatcgcgcatcagccatggcgcggtgaatacgttcccgggccttgtacacaccgcccgtcaagccatgaaagccgggggtacctgaagtacgtagcgtcctagggtaaaactggtaattggggctaagtcgtaacaaggtaacc

SEQ ID NO: 17 - DNA, 1529 bp, Artificial Sequence
  Bacteroides_fluxus
ttacaatgaagagtttgatcctggctcaggatgaacgctagctacaggcttaacacatgcaagtcgaggggcagcatttttatagcaatataaaagatggcgaccggcgcacgggtgagtaacacgtatccaacctgccgataactcggggataacccttcgaaagaaggcctaatacccgatggcatatcccttccgcctggttgggatattaaagaacttcggttatcgatggggatgcgttccattagcttgttggcggggtaacggcccaccaaggcttcgatggataggggttctgagaggaaggtcccccacattggaactgagacacggtccaaactcctacgggaggcagcagtgaggaatattggtcaatggacgagagtctgaaccagccaagtagcgtgaaggatgaaggtcctatggattgtaaacttcttttatacgggaataaagtgcagtatgcatactgttttgtatgtaccgtatgaataaggatcggctaactccgtgccagcagccgcggtaatacggaggatccgagcgttatccggatttattgggtttaaagggagcgtaggcggatgcttaagtcagttgtgaaagtttgcggctcaaccgtaaaattgcagttgatactgggcgtcttgagtacagtagaggcaggcggaattcgtggtgtagcggtgaaatgcttagatatcacgaagaactccgattgcgaaggcagcctgctggactgtcactgacgctgatgctcgaaagtgtgggtatcaaacaggattagataccctggtagtccacacagtaaacgatgaatactcgctgttggcgatacacagtcagcggccaagcgaaagcgttaagtattccacctggggagtacgccggcaacggtgaaactcaaaggaattgacgggggcccgcacaagcggaggaacatgtggtttaattcgatgatacgcgaggaaccttacccgggcttgaattgcatatgagttatccggagacggataagccgcaaggcatatgtgaaggtgctgcatggttgtcgtcagctcgtgccgtgaggtgtcggcttaagtgccataacgagcgcaacccttatcgatagttaccatcaggtcatgctggggactctgtcgagactgccgtcgtaagatgcgaggaaggtggggatgacgtcaaatcagcacggcccttacgtccggggccacacacgtgttacaatggggggtacagaaggccgctacacagcgatgtgatgccaatccccaaaacccctctcagttcggattggagtctgcaacccgactccatgaagctggattcgctagtaatcgcgcatcagccacggcgcggtgaatacgttcccgggccttgtacacaccgcccgtcaagccatgaaagccgggggtacctgaagtgcgtaaccgcgaggagcgccctagggtaaaactggtgattggggctaagtcgtaacaaggtagccgtaccggaaggtgcggctggaacacctcctttct

SEQ ID NO: 18 - DNA, 1486 bp, Artificial Sequence
  Bacteroides_helcogenes
agagtttgatcctggctcaggatgaacgctagctacaggcttaacacatgcaagtcgaggggcagcattgtcatagcaatatgacagatggcgaccggcgcacgggtgagtaacacgtatccaacctgccttccactcgggaatagcctttcgaaagaaagattaatgcccgatggcactgaaagaggtcatcctttttcagttaaagaatttcggtggaagatggggatgcgttccattagcttgttggcggggtaacggcccaccaaggcatcgatggataggggttctgagaggaaggtcccccacattggaactgagacacggtccaaactcctacgggaggcagcagtgaggaatattggtcaatgggcgggagcctgaaccagccaagtagcgtgaaggatgactgccctatgggttgtaaacttcttttataagggaataaaacgggccacgtgtggccttttgcatgtaccttatgaataaggatcggctaactccgtgccagcagccgcggtaatacggaggatccgagcgttatccggatttattgggtttaaagggagcgcagacggggtcttaagtcagttgtgaaagtttgcggctcaaccgtaaaattgcagttgatactggggctcttgagtgcagtataggcaggcggaattcgtggtgtagcggtgaaatgcttagatatcacgaagaactccgattgcgaaggcagcctgctggactgtaactgacgttcatgctcgaaagtgcgggtatcaaacaggattagataccctggtagtccgcacagtaaacgatgaatactcgctgttggcgatacacagtcagcggccaagcgaaagcgttaagtattccacctggggagtacgccggcaacggtgaaactcaaaggaattgacgggggcccgcacaagcggaggaacatgtggtttaattcgatgatacgcgaggaaccttacccgggcttgaattgctaatgaatatggcggaaacgtcatagccgcaaggccttagtgaaggtgctgcatggttgtcgtcagctcgtgccgtgaggtgtcggcttaagtgccataacgagcgcaacccttatctatagttaccatcaggcaatgctggggactctatggagactgccgtcgtaagatgtgaggaaggttgggatgacgtcaaatcagcacggcccttacgtccggggctacacacgtgttacaatggggggtacagaaggcagctacacagcgatgtgatgctaatcccaaaaacctctctcagttcggactggagtctgcaacccgactccacgaagctggattcgctagtaatcgcgcatcagccacggcgcggtgaatacgttcccgggccttgtacacaccgcccgtcaagccatgaaagccgggggtacctgaagtgcgtaaccgcgaggagcgccctagggtaaaactggtgattggggctaagtcgtaacaaggtaacc

SEQ ID NO: 19 - DNA, 1513 bp, Artificial Sequence
  Bacteroides_helcogenes
agagtttgatcctggctcaggatgaacgctagctacaggcttaacacatgcaagtcgaggggcagcattgtcatagcaatatgacagatggcgaccggcgcacgggtgagtaacacgtatccaacctgccttccactcgggaatagcctttcgaaagaaagattaatgcccgatggcactgaaagaggtcatcctttttcagttaaagaatttcggtggaagatggggatgcgttccattagcttgttggcggggtaacggcccaccaaggcatcgatggataggggttctgagaggaaggtcccccacattggaactgagacacggtccaaactcctacgggaggcagcagtgaggaatattggtcaatgggcgggagcctgaaccagccaagtagcgtgaaggatgactgccctatgggttgtaaacttcttttataagggaataaaacgggccacgtgtggccttttgcatgtaccttatgaataaggatcggctaactccgtgccagcagccgcggtaatacggaggatccgagcgttatccggatttattgggtttaaagggagcgcagacggggtcttaagtcagttgtgaaagtttgcggctcaaccgtaaaattgcagttgatactggggctcttgagtgcagtataggcaggcggaattcgtggtgtagcggtgaaatgcttagatatcacgaagaactccgattgcgaaggcagcctgctggactgtaactgacgttcatgctcgaaagtgcgggtatcaaacaggattagataccctggtagtccgcacagtaaacgatgaatactcgctgttggcgatacacagtcagcggccaagcgaaagcgttaagtattccacctggggagtacgccggcaacggtgaaactcaaaggaattgacgggggcccgcacaagcggaggaacatgtggtttaattcgatgatacgcgaggaaccttacccgggcttgaattgctaatgaatatggcggaaacgtcatagccgcaaggcattagtgaaggtgctgcatggttgtcgtcagctcgtgccgtgaggtgtcggcttaagtgccataacgagcgcaacccttatctatagttaccatcaggcaatgctggggactctatggagactgccgtcgtaagatgtgaggaaggttgggatgacgtcaaatcagcacggcccttacgtccggggctacacacgtgttacaatggggggtacagaaggcagctacacagcgatgtgatgctaatcccaaaaacctctctcagttcggactggagtctgcaacccgactccacgaagctggattcgctagtaatcgcgcatcagccacggcgcggtgaatacgttcccgggccttgtacacaccgcccgtcaagccatgaaagccgggggtacctgaagtgcgtaaccgcgaggagcgccctagggtaaaactggtgattggggctaagtcgtaacaaggtagccgtaccggaaggtgcggctggaacacct

SEQ ID NO: 20 - DNA, 1326 bp, Artificial Sequence
  Bacteroides_intestinalis
gagtttgatcctggctcaggatgaacgctagctacaggcttaacacatgcaagtcgagggaccggcgcacgggtgagtaacacgtatccaacctgccgattattccgggatagcctttcgaaagaaagattaatactggatagctaaagtcgataatcgatggggatgcgttccattagtttgttggcggggtaacggcccaccaagacatcgatggataggggttctgagaggaaggtcccccacattggaactgagacacggtccaaactcctacgggaggcagcagtgaggaatattggtcaatggacgagagtctgaaccagccaagtagcgtgaaggatgactgcctatgggttgtaaacttcttttatatgggaatatgtatgtaccatacgaataaggatcggctaactccgtgccagcagccgcggtaatacggaggatccragcgttatccggatttattgggtttaaagggagcgtaggcggattattaagtcagttgtgaaagtttgcggctcaaccgtaaaattgcagttgatactggtagtcttgagtgcagcagaggtaggcggaattcgtggtgtagcggtgaaatgcttagatatcacgaagaactccgattgcgaaggcagcttactggactgactgacgctgatgctcgaaagtgtgggtatcaaacaggattagataccctggtagtccacacagtaaacgatgaatactcgctgtttgcgagcaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgtgaaggtgctgcatggttgtcgtcagctcgtgccgtgaggtgtcggcttaagtgccataacgagcgcaacccttatctttagttactaacagctgaggactctagagagactgccgtcgtaagatggaggaaggtggggatgacgtcaaatcagcacggcccttacgtccggggctacacacgtgttacaatggggggcagaaggcagctacacagcgatgtgatgctaatcccacctctctcagttcggatggagtctgcaacccgactccagaagctggattcgctagtaatcgcgcatcagccacggcgcggtgaatacgttcccgggccttgtacacaccgcccgtcaagccatgaaagccgggggtacctgaagtacgtagcgtcctagggtaaaactggtaattggggctaagtcgtaacaaggtaacc

SEQ ID NO: 21 - DNA, 1527 bp, Artificial Sequence
  Bacteroides_intestinalis
ttacaatgaagagtttgatcctggctcaggatgaacgctagctacaggcttaacacatgcaagtcgaggggcagcatgacctagcaataggttgatggcgaccggcgcacgggtgagtaacacgtatccaacctgccgattattccgggatagcctttcgaaagaaagattaatactggatagcataacgagaaggcatcttcttgttattaaagaatttcgataatcgatggggatgcgttccattagtttgttggcggggtaacggcccaccaagacatcgatggataggggttctgagaggaaggtcccccacattggaactgagacacggtccaaactcctacgggaggcagcagtgaggaatattggtcaatggacgagagtctgaaccagccaagtagcgtgaaggatgactgccctatgggttgtaaacttcttttatatgggaataaagtgagccacgtgtggctttttgtatgtaccatacgaataaggatcggctaactccgtgccagcagccgcggtaatacggaggatccgagcgttatccggatttattgggtttaaagggagcgtaggcggattattaagtcagttgtgaaagtttgcggctcaaccgtaaaattgcagttgatactggtagtcttgagtgcagcagaggtaggcggaattcgtggtgtagcggtgaaatgcttagatatcacgaagaactccgattgcgaaggcagcttactggactgtaactgacgctgatgctcgaaagtgtgggtatcaaacaggattagataccctggtagtccacacagtaaacgatgaatactcgctgtttgcgatatacagcaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcaactgacggatttggaaacagatcttccttcgggcagttgtgaaggtgctgcatggttgtcgtcagctcgtgccgtgaggtgtcggcttaagtgccataacgagcgcaacccttatctttagttactaacaggtcatgctgaggactctagagagactgccgtcgtaagatgtgaggaaggtggggatgacgtcaaatcagcacggcccttacgtccggggctacacacgtgttacaatggggggtacagaaggcagctacacagcgatgtgatgctaatcccaaaagcctctctcagttcggattggagtctgcaacccgactccatgaagctggattcgctagtaatcgcgcatcagccacggcgcggtgaatacgttcccgggccttgtacacaccgcccgtcaagccatgaaagccgggggtacctgaagtacgtaaccgcaaggagcgtcctagggtaaaactggtaattggggctaagtcgtaacaaggtagccgtaccggaaggtgcggctggaacacctcctttct

SEQ ID NO: 22 - DNA, 1326 bp, Artificial Sequence
  Bacteroides_intestinalis
gagtttgatcctggctcaggatgaacgctagctacaggcttaacacatgcaagtcgagggaccggcgcacgggtgagtaacacgtatccaacctgccgattattccgggatagcctttcgaaagaaagattaatactggatagctaaagtcgataatcgatggggatgcgttccattagtttgttggcggggtaacggcccaccaagacatcgatggataggggttctgagaggaaggtcccccacattggaactgagacacggtccaaactcctacgggaggcagcagtgaggaatattggtcaatggacgagagtctgaaccagccaagtagcgtgaaggatgactgcctatgggttgtaaacttcttttatatgggaatatgtatgtaccatacgaataaggatcggctaactccgtgccagcagccgcggtaatacggaggatccgagcgttatccggatttattgggtttaaagggagcgtaggcggattattaagtcagttgtgaaagtttgcggctcaaccgtaaaattgcagttgatactggtagtcttgagtgcagcagaggtaggcggaattcgtggtgtagcggtgaaatgcttagatatcacgaagaactccgattgcgaaggcagcttactggactgactgacgctgatgctcgaaagtgtgggtatcaaacaggattagataccctggtagtccacacagtaaacgatgaatactcgctgtttgcgagcaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgtgaaggtgctgcatggttgtcgtcagctcgtgccgtgaggtgtcggcttaagtgccataacgagcgcaacccttatctttagttactaacagctgaggactctagagagactgccgtcgtaagatggaggaaggtggggatgacgtcaaatcagcacggcccttacgtccggggctacacacgtgttacaatggggggcagaaggcagctacacagcgatgtgatgctaatcccacctctctcagttcggatggagtctgcaacccgactccagaagctggattcgctagtaatcgcgcatcagccacggcgcggtgaatacgttcccgggccttgtacacaccgcccgtcaagccatgaaagccgggggtacctgaagtacgtagcgtcctagggtaaaactggtaattggggctaagtcgtaacaaggtaacc

SEQ ID NO: 23 - DNA, 1533 bp, Artificial Sequence
  Bacteroides_ovatus
ttacaatgaagagtttgatcctggctcaggatgaacgctagctacaggcttaacacatgcaagtcgaggggcagcattttagtttgcttgcaaactgaagatggcgaccggcgcacgggtgagtaacacgtatccaacctgccgataactccgggatagcctttcgaaagaaagattaataccggatggcatacgaatatcgcatgatatttttattaaagaatttcggttatcgatggggatgcgttccattagtttgttggcggggtaacggcccaccaagactacgatggataggggttctgagaggaaggtcccccacattggaactgagacacggtccaaactcctacgggaggcagcagtgaggaatattggtcaatgggcgagagcctgaaccagccaagtagcgtgaaggatgaaggctctatgggtcgtaaacttcttttatatgggaataaagttttccacgtgtggaattttgtatgtaccatatgaataaggatcggctaactccgtgccagcagccgcggtaatacggaggatccgagcgttatccggatttattgggtttaaagggagcgtaggtggattgttaagtcagttgtgaaagtttgcggctcaaccgtaaaattgcagttgaaactggcagtcttgagtacagtagaggtgggcggaattcgtggtgtagcggtgaaatgcttagatatcacgaagaactccgattgcgaaggcagctcactagactgttactgacactgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcaacagaatatattggaaacagtatagccgtaaggctgttgtgaaggtgctgcatggttgtcgtcagctcgtgccgtgaggtgtcggcttaagtgccataacgagcgcaacccttatctttagttactaacaggttatgctgaggactctagagagactgccgtcgtaagatgtgaggaaggtggggatgacgtcaaatcagcacggcccttacgtccggggctacacacgtgttacaatggggggtacagaaggccgctacctggtgacaggatgctaatcccaaaaacctctctcagttcggatcgaagtctgcaacccgacttcgtgaagctggattcgctagtaatcgcgcatcagccatggcgcggtgaatacgttcccgggccttgtacacaccgcccgtcaagccatgaaagccgggggtacctgaagtacgtaaccgcaaggagcgtcctagggtaaaactggtaattggggctaagtcgtaacaaggtagccgtaccggaaggtgcggctggaacacctcctttct

SEQ ID NO: 24 - DNA, 1392 bp, Artificial Sequence
  Bacteroides_ovatus
tttagtttgcttgcaaactgaagaatggcgaccgcgcgcacgggtgagtaacacgtatccaacctgccgataactccgggatagcctttcgaaagaaagattaataccggatggcatactaatatcgcatgatatttttattaaagaatttcggttatcgatggggatgcgttccattagtttgttggcggggtaacggcccaccaagacaacgatggataggggttctgagaggaaggtcccccacattggaactgagacacggtccaaactcctacgggaggcagcagtgaggaatattggtcaatgggcgagagcctgaaccagccaagtagcgtgaaggatgactgctctatgggtcgtaaacttcttttatatgggaataaagtattccacgtgtggaattttgtatgtaccatatgaataaggatcggctaactccgtgccagcagccgcggtaatacggaggatccgagcgttatccggatttattgggtttaaagggagcgtaggtggattgttaagtcagttgtgaaagtttgcggctcaaccgtaaaattgcagttgaaactggcagtcttgagtacagtagaggtgggcggaattcgtggtgtagcggtgaaatgcttagatatcacgaagaactccgattgcgaaggcagctcactagactgtcactgacactgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcaacagaatattttggaaacagtatagccgcaaggctgttgtgaaggtgctgcatggttgtcgtcagctcgtgccgtgaggtgtcggcttaagtgccataacgagcgcaacccttatctttagttactaacaggtcatgctgaggactctagagagactgccgtcgtaagatgtgaggaaggtggggatgacgtcaaatcagcacggcccttacgtccggggctacacacgtgttacaatggggggtacagaaggcagctacctggcgacaggatgctaatcccaaaaacctctctcagttcggatcgaagtctgcaacccgacttcgtgaagctggattcgctagtaatcgcgcatcagccatggcgcggtgaatacgttcccgggccttgtacacaccgcccgtcaagccatgaaagcccgggggtacctgaagtacgtaaccgcaaggagcgtcctagggtaaaac

SEQ ID NO: 25 - DNA, 1455 bp, Artificial Sequence
  Bacteroides_ovatus
gatcatggctcaggatgaacgctagctacaggcttaacacatacaagtcgtggggcagcattttatgtttgtttgcaaactgaagatggcgaccggcgcacgggtgagtaacacgtatccaacctgccgataactccggaatagcctttcgaaagaaagattaataccggatagcatacgatatcgcatgatatttttattaaagaatttcggttatcgatggggatgcgttccattagtttgttggcggggtaacggcccaccaagactacgatggataggggttctgagaggaaggtcccccacattggaactgagacacggtccaaactcctacgggaggcagcagtgaggaatattggtcaatgggcgagagcctgaaccagccaagtagcgtgaaggatgaaggctctatgggtcgtaaacttcttttatatgggaataaagttttccacgtgtggaattttgtatgtaccatatgaataaggatcggactactccgtgccagcagccgcggtaatacggaggatccgagcgttatccggatttattgggtttaaagggagcgtaggtggattgttaagtcagttgtgaaagtttgcggctcaaccgtaaaattgcagttgaaactggcagtcttgagtacagtagaggtgggcggaattcgtggtgtagcggtgaaatgcttagatatcacgaagaactccgattgcgaaggcagctcactagactgttactgacactgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgagaaccttacccgggcttaaattgcaacagaatatattggaaacagtatagccgtaaggctgttgtgaaggtgctgcatggttgtcgtcagctcgtgccgtgaggtgtcggcttaagtgccataacgagcgcaacccttatctttagttactaacaggttatgctgaggactctagagagactgccgtcgtaagatgtgaggaaggtggggatgacgtcaaatcagcacggcccttacgtccggggctacacacgtgttacaatggggggtacagaaggcagctacctggtgacatgatgctaatcccaaaaacctctctcagttcggatcgaagtctgcaacccgacttcgtgaagctggattcgctagtaatcgcgcatcagccatggcgcggtgaatacgttcccgggccttgtacacaccgcccgtcaagccatgaaagccgggggtacctgaagtacgtaaccgcaaggagcgtcctagggtaaaactggtaa

SEQ ID NO: 26 - DNA, 1287 bp, Artificial Sequence
  Bacteroides_ovatus
gatgaacgctagctacaggcttgacacatgcaagtcgagggaccggcgcacgggtgagtaacacgtatccaacctgccgataactccggaatagcctttcgaaagaaagattaataccggatagctaaagtcggttatcgatggggatgcgttccattagtttgttggcggggtaacggcccaccaagactacgatggataggggttctgagaggaaggtcccccacattggaactgagacacggtccaaactcctacgggaggcagcagtgaggaatattggtcaatgggcgagagcctgaaccagccaagtagcgtgaaggatgaaggcttatgggtcgtaaacttcttttatatgggaatatgtatgtaccatatgaataaggatcggctaactccgtgccagcagccgcggtaatacggaggatccgagcgttatccggatttattgggtttaaagggagcgtaggtggattgttaagtcagttgtgaaagtttgcggctcaaccgtaaaattgcagttgaaactggcagtcttgagtacagtagaggtgggcggaattcgtggtgtagcggtgaaatgcttagatatcacgaagaactccgattgcgaaggcagctcactagactgactgacactgatgctcgaaagtgtgggtatcaaacaggattagataccctggtagtccacacagtaaacgatgaatactcgctgtttgcgagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgtgaaggtgctgcatggttgtcgtcagctcgtgccgtgaggtgtcggcttaagtgccataacgagcgcaacccttatctttagttactaacagctgaggactctagagagactgccgtcgtaagatggaggaaggtggggatgacgtcaaatcagcacggcccttacgtccggggctacacacgtgttacaatggggggcagaaggcagctacctggcgacaggatgctaatcccacctctctcagttcggacgaagtctgcaacccgacttcggaagctggattcgctagtaatcgcgcatcagccatggcgcggtgaatacgttcccgggccttgtacacaccgcccgtcaagccatgaaagccgggggtacctgaagtacgtagcgtcctagggtaaaactggtaattggggc

SEQ ID NO: 27 - DNA, 1509 bp, Artificial Sequence
  Bacteroides_ovatus
agagtttgatcctggctcaggatgaacgctagctacaggcttaacacatgcaagtcgaggggcagcattttagtttgcttgcaaactaaagatggcgaccggcgcacgggtgagtaacacgtatccaacctgccgataactcggggatagcctttcgaaagaaagattaatatccgatagtatattaaaaccgcatggttttactattaaagaatttcggttatcgatggggatgcgttccattagtttgttggcggggtaacggcccaccaagactacgatggataggggttctgagaggaaggtcccccacattggaactgagacacggtccaaactcctacgggaggcagcagtgaggaatattggtcaatggacgagagtctgaaccagccaagtagcgtgaaggatgactgccctatgggttgtaaacttcttttatatgggaataaagtattccacgtgtgggattttgtatgtaccatatgaataaggatcggctaactccgtgccagcagccgcggtaatacggaggatccgagcgttatccggatttattgggtttaaagggagcgtaggtggattgttaagtcagttgtgaaagtttgcggctcaaccgtaaaattgcagttgaaactggcagtcttgagtacagtagaggtgggcggaattcgtggtgtagcggtgaaatgcttagatatcacgaagaactccgattgcgaaggcagctcactagactgcaactgacactgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcatttgaataatctggaaacaggttagccgcaaggcaaatgtgaaggtgctgcatggttgtcgtcagctcgtgccgtgaggtgtcggcttaagtgccataacgagcgcaacccttatctttagttactaacaggtcatgctgaggactctagagagactgccgtcgtaagatgtgaggaaggtggggatgacgtcaaatcagcacggcccttacgtccggggctacacacgtgttacaatggggggtacagaaggcagctacctggcgacaggatgctaatcccaaaaacctctctcagttcggatcgaagtctgcaacccgacttcgtgaagctggattcgctagtaatcgcgcatcagccatggcgcggtgaatacgttcccgggccttgtacacaccgcccgtcaagccatgaaagccgggggtacctgaagtacgtaaccgcaaggagcgtcctagggtaaaactggtaattggggctaagtcgtaacaaggtagccgtaccggaaggtgcggctg

SEQ ID NO: 28 - DNA, 1311 bp, Artificial Sequence
  Bacteroides_ovatus
gatcctggctcaggatgaacgctagctacaggcttaacacatgcaagtcgagggaccggcgcacgggtgagtaacacgtatccaacctgccgataactccggaatagcctttcgaaagaaagattaataccggatagttaaagtcggttatcgatggggatgcgttccattagtttgttggcggggtaacggcccaccaagcctacgatggataggggttctgagaggaaggtcccccacattggaactgagacacggtccaaactcctacgggaggcagcagtgaggaatattggtcaatgggcgagagcctgaaccagccaagtagcgtgaaggatgaaggcttatgggtcgtaaacttcttttatatgggaatatgtatgtaccatatgaataaggatcggctaactccgtgccagcagccgcggtaatacggaggatccgagcgttatccggatttattgggtttaaagggagcgtaggtggattgttaagtcagttgtgaaagtttgcggctcaaccgtaaaattgcagttgaaactggcagtcttgagtacagtagaggtgggcggaattcgtggtgtagcggtgaaatgcttagatatcacgaagaactccgattgcgaaggcagctcactagactgactgacactgatgctcgaaagtgtgggtatcaaacaggattagataccctggtagtccacacagtaaacgatgaatactcgctgtttgcgagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgtgaaggtgctgcatggttgtcgtcagctcgtgccgtgaggtgtcggcttaagtgccataacgagcgcaacccttatctttagttactaacagctgaggactctagagagactgccgtcgtaagatggaggaaggtggggatgacgtcaaatcatcacggcccttacgtccggggctacacacgtgttacaatggggggcagaaggcggctacctggtgacaggatgctaatcccacctctctcagttcggacgaagtctgcaacccgacttcggaagctggattcgctagtaatcgcgcatcagccatggcgcggtgaatacgttcccgggccttgtacacaccgcccgtcaagccatgaaagccgggggtacctgaagtacgtagcgtcctaggtaaaactggtaattggggctaagtcgtaaca

SEQ ID NO: 29 - DNA, 1529 bp, Artificial Sequence
  Bacteroides_sp_1_1_30
ttacaatgaagagtttgatcctggctcaggatgaacgctagctacaggcttaacacatgcaagtcgaggggcagcatttcgctagcaatagtgaagatggcgaccggcgcacgggtgagtaacacgtatccaacctgccgataactcggggatagcctttcgaaagaaagattaatatccgatagtatattaaaaccgcatggttttactattaaagaatttcggttatcgatggggatgcgttccattagtttgttggcggggtaacggcccaccaagactacgatggataggggttctgagaggaaggtcccccacattggaactgagacacggtccaaactcctacgggaggcagcagtgaggaatattggtcaatggacgagagtctgaaccagccaagtagcgtgaaggatgactgccctatgggttgtaaacttcttttatatgggaataaagtattccacgtgtgggattttgtatgtaccatatgaataaggatcggctaactccgtgccagcagccgcggtaatacggaggatccgagcgttatccggatttattgggtttaaagggagcgtaggtggattgttaagtcagttgtgaaagtttgcggctcaaccgtaaaattgcagttgaaactggcagtcttgagtacagtagaggtgggcggaattcgtggtgtagcggtgaaatgcttagatatcacgaagaactccgattgcgaaggcagctcactagactgcaactgacactgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcatttgaataatctggaaacaggttagccgcaaggcaaatgtgaaggtgctgcatggttgtcgtcagctcgtgccgtgaggtgtcggcttaagtgccataacgagcgcaacccttatctttagttactaacaggttatgctgaggactctagagagactgccgtcgtaagatgtgaggaaggtggggatgacgtcaaatcagcacggcccttacgtccggggctacacacgtgttacaatggggggtacagaaggcagctacctggtgacaggatgctaatcccaaaaacctctctcagttcggatcgaagtctgcaacccgacttcgtgaagctggattcgctagtaatcgcgcatcagccatggcgcggtgaatacgttcccgggccttgtacacaccgcccgtcaagccatgaaagccgggggtacctgaagtacgtaaccgcaaggagcgtcctagggtaaaactggtaattggggctaagtcgtaacaaggtagccgtaccggaaggtgcggctggaacacctcctttct

SEQ ID NO: 30 - DNA, 1527 bp, Artificial Sequence
  Bacteroides_sp_20_3
acaacgaagagtttgatcctggctcaggatgaacgctagcgacaggcttaacacatgcaagtcgaggggcagcacaggtagcaataccgggtggcgaccggcgcacgggtgagtaacgcgtatgcaacttacctatcagagggggataacccggcgaaagtcggactaataccgcatgaagcaggggtccccgcatggggatatttgctaaagattcatcgctgatagataggcatgcgttccattaggcagttggcggggtaacggcccaccaaaccgacgatggataggggttctgagaggaaggtcccccacattggtactgagacacggaccaaactcctacgggaggcagcagtgaggaatattggtcaatgggcgtaagcctgaaccagccaagtcgcgtgagggatgaaggttctatggatcgtaaacctcttttataagggaataaagtgcgggacgtgtcctgttttgtatgtaccttatgaataaggatcggctaactccgtgccagcagccgcggtaatacggaggatccgagcgttatccggatttattgggtttaaagggtgcgtaggcggccttttaagtcagcggtgaaagtctgtggctcaaccatagaattgccgttgaaactggggggcttgagtatgtttgaggcaggcggaatgcgtggtgtagcggtgaaatgcttagatatcacgcagaaccccgattgcgaaggcagcctgccaagccatgactgacgctgatgcacgaaagcgtggggatcaaacaggattagataccctggtagtccacgcagtaaacgatgatcactagctgtttgcgatacagtgtaagcggcacagcgaaagcgttaagtgatccacctggggagtacgccggcaacggtgaaactcaaaggaattgacgggggcccgcacaagcggaggaacatgtggtttaattcgatgatacgcgaggaaccttacccgggtttgaacgcattcggaccgaggtggaaacaccttttctagcaatagccgtttgcgaggtgctgcatggttgtcgtcagctcgtgccgtgaggtgtcggcttaagtgccataacgagcgcaacccttgccactagttactaacaggtgatgctgaggactctggtgggactgccagcgtaagctgcgaggaaggcggggatgacgtcaaatcagcacggcccttacatccggggcgacacacgtgttacaatggcgtggacaaagggagccacctggcgacagggagcgaatccccaaaccacgtctcagttcggatcggagtctgcaacccgactccgtgaagctggattcgctagtaatcgcgcatcagccatggcgcggtgaatacgttcccgggccttgtacacaccgcccgtcaagccatgggagccgggggtacctgaagtccgtaaccgcgaggatcggcctagggtaaaactggtgactggggctaagtcgtaacaaggtagccgtaccggaaggtgcggctggaacacctcctttct

SEQ ID NO: 31 - DNA, 1533 bp, Artificial Sequence
  Bacteroides_sp_2_1_22
ttacaatgaagagtttgatcctggctcaggatgaacgctagctacaggcttaacacatgcaagtcgaggggcagcattttagtttgcttgcaaactaaagatggcgaccggcgcacgggtgagtaacacgtatccaacctgccgataactcggggatagcctttcgaaagaaagattaatatccgatggtatattaaaaccgcatggttttactattaaagaatttcggttatcgatggggatgcgttccattagtttgttggcggggtaacggcccaccaagactacgatggataggggttctgagaggaaggtcccccacattggaactgagacacggtccaaactcctacgggaggcagcagtgaggaatattggtcaatggacgagagtctgaaccagccaagtagcgtgaaggatgactgccctatgggttgtaaacttcttttatatgggaataaagtattccacgtgtggaattttgtatgtaccatatgaataaggatcggctaactccgtgccagcagccgcggtaatacggaggatccgagcgttatccggatttattgggtttaaagggagcgtaggtggattgttaagtcagttgtgaaagtttgcggctcaaccgtaaaattgcagttgaaactggcagtcttgagtacagtagaggtgggcggaattcgtggtgtagcggtgaaatgcttagatatcacgaagaactccgattgcgaaggcagctcactagactgcaactgacactgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcatttgaataatctggaaacaggttagccgcaaggcaaatgtgaaggtgctgcatggttgtcgtcagctcgtgccgtgaggtgtcggcttaagtgccataacgagcgcaacccttatctttagttactaacaggtcatgctgaggactctagagagactgccgtcgtaagatgtgaggaaggtggggatgacgtcaaatcagcacggcccttacgtccggggctacacacgtgttacaatggggggtacagaaggcagctacctggcgacaggatgctaatcccaaaaacctctctcagttcggatcgaagtctgcaacccgacttcgtgaagctggattcgctagtaatcgcgcatcagccatggcgcggtgaatacgttcccgggccttgtacacaccgcccgtcaagccatgaaagccgggggtacctgaagtacgtaaccgcaaggagcgtcctagggtaaaactggtaattggggctaagtcgtaacaaggtagccgtaccggaaggtgcggctggaacacctcctttct

SEQ ID NO: 32 - DNA, 1525 bp, Artificial Sequence
  Bacteroides_sp_2_2_4
tacaatgaagagtttgatcctggctcaggatgaacgctagctacaggcttaacacatgcaagtcgaggggcagcatttcgctagcaatagtgaagatggcgaccggcgcacgggtgagtaacacgtatccaacctgccgataactcggggatagcctttcgaaagaaagattaatatccgatagtatattaaaaccgcatggttttactattaaagaatttcggttatcgatggggatgcgttccattagtttgttggcggggtaacggcccaccaagactacgatggataggggttctgagaggaaggtcccccacattggaactgagacacggtccaaactcctacgggaggcagcagtgaggaatattggtcaatggacgagagtctgaaccagccaagtagcgtgaaggatgactgccctatgggttgtaaacttcttttatatgggaataaagtattccacgtgtgggattttgtatgtaccatatgaataaggatcggctaactccgtgccagcagccgcggtaatacggaggatccgagcgttatccggatttattgggtttaaagggagcgtaggtggattgttaagtcagttgtgaaagtttgcggctcaaccgtaaaattgcagttgaaactgggagtcttgagtacagtagaggtgggcggaattcgtggtgtagcggtgaaatgcttagatatcacgaagaactccgattgcgaaggcagctcactagactgtcactgacactgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcaaatgaataatctggaaacaggttagccgcaaggcatttgtgaaggtgctgcatggttgtcgtcagctcgtgccgtgaggtgtcggcttaagtgccataacgagcgcaacccttatctttagttactaacaggttatgctgaggactctagagagactgccgtcgtaagatgtgaggaaggtggggatgacgtcaaatcagcacggcccttacgtccggggctacacacgtgttacaatggggggtacagaaggcagctacctggtgacaggatgctaatcccaaaaacctctctcagttcggatcgaagtctgcaacccgacttcgtgaagctggattcgctagtaatcgcgcatcagccatggcgcggtgaatacgttcccgggccttgtacacaccgcccgtcaagccatgaaagccgggggtacctgaagtacgtaaccgcaaggagcgtcctagggtaaaactggtaattggggctaagtcgtaacaaggtagccgtaccggaaggtgcggctggaacacctcctt

SEQ ID NO: 33 - DNA, 1527 bp, Artificial Sequence
  Bacteroides_sp_3_1_19
acaacgaagagtttgatcctggctcaggatgaacgctagcgacaggcttaacacatgcaagtcgaggggcagcacaggtagcaataccgggtggcgaccggcgcacgggtgagtaacgcgtatgcaacttgcctatcagagggggataacccggcgaaagtcggactaataccgcatgaagcagggatcccgcatgggaatatttgctaaagattcatcgctgatagataggcatgcgttccattaggcagttggcggggtaacggcccaccaaaccgacgatggataggggttctgagaggaaggtcccccacattggtactgagacacggaccaaactcctacgggaggcagcagtgaggaatattggtcaatggccgagaggctgaaccagccaagtcgcgtgagggatgaaggttctatggatcgtaaacctcttttataagggaataaagtgcgggacgtgtcccgttttgtatgtaccttatgaataaggatcggctaactccgtgccagcagccgcggtaatacggaggatccgagcgttatccggatttattgggtttaaagggtgcgtaggcggccttttaagtcagcggtgaaagtctgtggctcaaccatagaattgccgttgaaactggggggcttgagtatgtttgaggcaggcggaatgcgtggtgtagcggtgaaatgcatagatatcacgcagaaccccgattgcgaaggcagcctgccaagccattactgacgctgatgcacgaaagcgtggggatcaaacaggattagataccctggtagtccacgcagtaaacgatgatcactagctgtttgcgatacactgtaagcggcacagcgaaagcgttaagtgatccacctggggagtacgccggcaacggtgaaactcaaaggaattgacgggggcccgcacaagcggaggaacatgtggtttaattcgatgatacgcgaggaaccttacccgggtttgaacgcattcggaccgaggtggaaacaccttttctagcaatagccgtttgcgaggtgctgcatggttgtcgtcagctcgtgccgtgaggtgtcggcttaagtgccataacgagcgcaacccttgccactagttactaacaggtaaagctgaggactctggtgggactgccagcgtaagctgcgaggaaggcggggatgacgtcaaatcagcacggcccttacatccggggcgacacacgtgttacaatggcgtggacaaagggaggccacctggcgacagggagcgaatccccaaaccacgtctcagttcggatcggagtctgcaacccgactccgtgaagctggattcgctagtaatcgcgcatcagccatggcgcggtgaatacgttcccgggccttgtacacaccgcccgtcaagccatgggagccgggggtacctgaagtccgtaaccgcgaggatcggcctagggtaaaactggtgactggggctaagtcgtaacaaggtagccgtaccggaaggtgcggctggaacacctcctttct

SEQ ID NO: 34 - DNA, 1533 bp, Artificial Sequence
  Bacteroides_sp_3_1_23
ttacaatgaagagtttgatcctggctcaggatgaacgctagctacaggcttaacacatgcaagtcgaggggcagcattttagtttgcttgcaaactgaagatggcgaccggcgcacgggtgagtaacacgtatccaacctgccgataactccggaatagcctttcgaaagaaagattaataccggatagtatacgaatatcgcatgatatttttattaaagaatttcggttatcgatggggatgcgttccattagtttgttggcggggtaacggcccaccaagactacgatggataggggttctgagaggaaggtcccccacattggaactgagacacggtccaaactcctacgggaggcagcagtgaggaatattggtcaatgggcgagagcctgaaccagccaagtagcgtgaaggatgaaggctctatgggtcgtaaacttcttttatatgggaataaagtattccacgtgtggaattttgtatgtaccatatgaataaggatcggctaactccgtgccagcagccgcggtaatacggaggatccgagcgttatccggatttattgggtttaaagggagcgtaggtggattgttaagtcagttgtgaaagtttgcggctcaaccgtaaaattgcagttgaaactggcagtcttgagtacagtagaggtgggcggaattcgtggtgtagcggtgaaatgcttagatatcacgaagaactccgattgcgaaggcagctcactagactgttactgacactgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcaacagaatatattggaaacagtatagccgtaaggctgttgtgaaggtgctgcatggttgtcgtcagctcgtgccgtgaggtgtcggcttaagtgccataacgagcgcaacccttatctttagttactaacaggtgatgctgaggactctagagagactgccgtcgtaagatgtgaggaaggtggggatgacgtcaaatcagcacggcccttacgtccggggctacacacgtgttacaatggggggtacagaaggcggctacctggtgacaggatgctaatcccaaaaacctctctcagttcggatcgaagtctgcaacccgacttcgtgaagctggattcgctagtaatcgcgcatcagccatggcgcggtgaatacgttcccgggccttgtacacaccgcccgtcaagccatgaaagccgggggtacctgaagtacgtaaccgcaaggagcgtcctagggtaaaactggtaattggggctaagtcgtaacaaggtagccgtaccggaaggtgcggctggaacacctcctttct

SEQ ID NO: 35 - DNA, 1446 bp, Artificial Sequence
  Bacteroides_sp_3_2_5
acaacgaagagtttgatcctggctcaggatgaacgctagcgacaggcttaacacatgcaagtcgaggggcagcacaggtagcaataccgggtggcgaccggcgcacgggtgagtaacgcgtatgcaacttgcctatcagagggggataacccggcgaaagtcggactaataccgcatgaagcaggggccccgcatggggatatttgctaaagattcatcgctgatagataggcatgcgttccattaggcagttggcggggtaacggcccaccaaaccgacgatggataggggttctgagaggaaggtcccccacattggtactgagacacggaccaaactcctacgggaggcagcagtgaggaatattggtcaatggccgagaggctgaaccagccaagtcgcgtgagggatgaaggttctatggatcgtaaacctcttttataagggaataaagtgcgggacgtgtcccgttttgtatgtaccttatgaataaggatcggctaactccgtgccagcagccgcggtaatacggaggatccgagcgttatccggatttattgggtttaaagggtgcgtaggcggccttttaagtcagcggtgaaagtctgtggctcaaccatagaattgccgttgaaactggggggcttgagtatgtttgaggcaggcggaatgcgtggtgtagcggtgaaatgcatagatatcacgcagaaccccgattgcgaaggcagcctgccaagccatgactgacgctgatgcacgaaagcgtggggatcaaacaggattagataccctggtagtccacgcagtaaacgatgatcactagctgtttgcgatacactgtaagcggcacagcgaaagcgttaagtgatccacctggggagtacgccggcaacggtgaaactcaaaggaattgacgggggcccgcacaagcggaggaacatgtggtttaattcgatgatacgcgaggaaccttacccgggtttgaacgcattcggaccgaggtggaaacaccttttctagcaatagccgtttgcgaggtgctgcatggttgtcgtcagctcgtgccgtgaggtgtcggcttaagtgccataacgagcgcaacccttgccactagttactaacaggtgatgctgaggactctggtgggactgccagcgtaagctgcgaggaaggcggggatgacgtcaaatcagcacggcccttacatccggggcgacacacgtgttacaatggcgtggacaaagggaggccacctggcgacagggagcgaatccccaaaccacgtctcagttcggatcggagtctgcaacccgactccgtgaagctggattcgctagtaatcgcgcatcagccatggcgcggtgaatacgttcccgggccttgtacacaccgcccgtcaagccatgggagccgggggtacctgaagtccgtaaccgcgaggatcg

SEQ ID NO: 36 - DNA, 1531 bp, Artificial Sequence
  Bacteroides_sp_4_1_36
ttacaatgaagagtttgatcctggctcaggatgaacgctagctacaggcttaacacatgcaagtcgaggggcagcatgaacttagcttgctaagtttgatggcgaccggcgcacgggtgagtaacacgtatccaacctgccgatgactcggggatagcctttcgaaagaaagattaatacccgatggcatagttcttccgcatggtggaactattaaagaatttcggtcatcgatggggatgcgttccattaggttgttggcggggtaacggcccaccaagccttcgatggataggggttctgagaggaaggtcccccacattggaactgagacacggtccaaactcctacgggaggcagcagtgaggaatattggtcaatggacgagagtctgaaccagccaagtagcgtgaaggatgactgccctatgggttgtaaacttcttttatacgggaataaagtgaggcacgtgtgcctttttgtatgtaccgtatgaataaggatcggctaactccgtgccagcagccgcggtaatacggaggatccgagcgttatccggatttattgggtttaaagggagcgtaggcggacgcttaagtcagttgtgaaagtttgcggctcaaccgtaaaattgcagttgatactgggtgtcttgagtacagtagaggcaggcggaattcgtggtgtagcggtgaaatgcttagatatcacgaagaactccgattgcgaaggcagcttgctggactgtaactgacgctgatgctcgaaagtgtgggtatcaaacaggattagataccctggtagtccacacagtaaacgatgaatactcgctgtttgcgatatacagtaagcggccaagcgaaagcgttaagtattccacctggggagtacgccggcaacggtgaaactcaaaggaattgacgggggcccgcacaagcggaggaacatgtggtttaattcgatgatacgcgaggaaccttacccgggcttgaattgcaactgaatgatgtggagacatgtcagccgcaaggcagttgtgaaggtgctgcatggttgtcgtcagctcgtgccgtgaggtgtcggcttaagtgccataacgagcgcaacccttatcgatagttaccatcaggttatgctggggactctgtcgagactgccgtcgtaagatgtgaggaaggtggggatgacgtcaaatcagcacggcccttacgtccggggctacacacgtgttacaatggggggtacagaaggcagctacacggcgacgtgatgctaatccctaaagcctctctcagttcggattggagtctgcaacccgactccatgaagctggattcgctagtaatcgcgcatcagccacggcgcggtgaatacgttcccgggccttgtacacaccgcccgtcaagccatgaaagccgggggtacctgaagtgcgtaaccgcaaggagcgccctagggtaaaactggtgattggggctaagtcgtaacaaggtagccgtaccggaaggtgcggctggaacacctcctttct

SEQ ID NO: 37 - DNA, 1489 bp, Artificial Sequence
  Bacteroides_sp_AR20
gagtttgatcctggctcaggatgaacgctagctacaggcttaacacatgcaagtcgaggggcagcatgaacttagcttgctaagtttgatggcgaccggcgcacgggtgagtaacacgtatccaacctgccgatgactcggggatagcctttcgaaagaaagattaatacccgatggcatagttcttccgcatggtagaactattaaagaatttcggtcatcgatggggatgcgttccattaggttgttggcggggtaacggcccaccaagccttcgatggataggggttctgagaggaaggtcccccacattggaactgagacacggtccaaactcctacgggaggcagcagtgaggaatattggtcaatggacgagagtctgaaccagccaagtagcgtgaaggatgactgccctatgggttgtaaacttcttttatacgggaataaagtgaggcacgcgtgcctttttgtatgtaccgtatgaataaggatcggctaactccgtgccagcagccgcggtaatacggaggatccgagcgttatccggatttattgggtttaaagggagcgtaggcggacgcttaagtcagttgtgaaagtttgcggctcaaccgtaaaattgcagttgatactgggtgtcttgagtacagtagaggcaggcggaattcgtggtgtagcggtgaaatgcttagatatcacgaagaactccgattgcgaaggcagcctgctggactgtaactgacgctgatgctcgaaagtgtgggtatcaaacaggattagataccctggtagtccacacagtaaacgatgaatactcgctgtttgcgatatacagtaagcggccaagcgaaagcgttaagtattccacctggggagtacgccggcaacggtgaaactcaaaggaattgacgggggcccgcacaagcggaggaacatgtggtttaattcgatgatacgcgaggaaccttacccgggcttgaattgcaactgaatgatgtggagacatgtcagccgcaaggcagttgtgaaggtgctgcatggttgtcgtcagctcgtgccgtgaggtgtcggcttaagtgccataacgagcgcaacccttatcgatagttaccatcaggttatgctggggactctgtcgagactgccgtcgtaagatgtgaggaaggtggggatgacgtcaaatcagcacggcccttacgtccggggctacacacgtgttacaatggggggtacagaaggcagctacacggcgacgtgatgctaatccctaaagcctctctcagttcggattggagtctgcaacccgactccatgaagctggattcgctagtaatcgcgcatcagccacggcgcggtgaatacgttcccgggccttgtacacaccgcccgtcaagccatgaaagccgggggtacctgaagtgcgtaaccgcaaggagcgccctagggtaaaactggtgattggggctaagtcgtaacaaggtagccgt

SEQ ID NO: 38 - DNA, 1517 bp, Artificial Sequence
  Bacteroides_sp_D1
agagtttgatcctggctcaggatgaacgctagctacaggcttaacacatgcaagtcgaggggcagcattttagtttgcttgcaaactaaagatggcgaccggcgcacgggtgagtaacacgtatccaacctgccgataactcggggatagcctttcgaaagaaagattaatatccgatggtatattaaaaccgcatggttttactattaaagaatttcggttatcgatggggatgcgttccattagtttgttggcggggtaacggcccaccaagactacgatggataggggttctgagaggaaggtcccccacattggaactgagacacggtccaaactcctacgggaggcagcagtgaggaatattggtcaatggacgagagtctgaaccagccaagtagcgtgaaggatgactgccctatgggttgtaaacttcttttatatgggaataaagtattccacgtgtggaattttgtatgtaccatatgaataaggatcggctaactccgtgccagcagccgcggtaatacggaggatccgagcgttatccggatttattgggtttaaagggagcgtaggtggattgttaagtcagttgtgaaagtttgcggctcaaccgtaaaattgcagttgaaactggcagtcttgagtacagtagaggtgggcggaattcgtggtgtagcggtgaaatgcttagatatcacgaagaactccgattgcgaaggcagctcactagactgcaactgacactgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcatttgaataatctggaaacaggttagccgcaaggcaaatgtgaaggtgctgcatggttgtcgtcagctcgtgccgtgaggtgtcggcttaagtgccataacgagcgcaacccttatctttagttactaacaggtcatgctgaggactctagagagactgccgtcgtaagatgtgaggaaggtggggatgacgtcaaatcagcacggcccttacgtccggggctacacacgtgttacaatggggggtacagaaggcagctacctggcgacaggatgctaatcccaaaaacctctctcagttcggatcgaagtctgcaacccgacttcgtgaagctggattcgctagtaatcgcgcatcagccatggcgcggtgaatacgttcccgggccttgtacacaccgcccgtcaagccatgaaagccgggggtacctgaagtacgtaaccgcaaggagcgtcctagggtaaaactggtaattggggctaagtcgtaacaaggtagccgtaccggaaggtgcggctggaacacct

SEQ ID NO: 39 - DNA, 1531 bp, Artificial Sequence
  Bacteroides_sp_D20
ttacaatgaagagtttgatcctggctcaggatgaacgctagctacaggcttaacacatgcaagtcgaggggcagcatgaacttagcttgctaagtttgatggcgaccggcgcacgggtgagtaacacgtatccaacctgccgatgactcggggatagcctttcgaaagaaagattaatacccgatggcataattcttccgcatggtagaactattaaagaatttcggtcatcgatggggatgcgttccattaggttgttggcggggtaacggcccaccaagccttcgatggataggggttctgagaggaaggtcccccacattggaactgagacacggtccaaactcctacgggaggcagcagtgaggaatattggtcaatggacgagagtctgaaccagccaagtagcgtgaaggatgactgccctatgggttgtaaacttcttttatacgggaataaagtgaggcacgtgtgcctttttgtatgtaccgtatgaataaggatcggctaactccgtgccagcagccgcggtaatacggaggatccgagcgttatccggatttattgggtttaaagggagcgtaggcggacgcttaagtcagttgtgaaagtttgcggctcaaccgtaaaattgcagttgatactgggtgtcttgagtacagtagaggcaggcggaattcgtggtgtagcggtgaaatgcttagatatcacgaagaactccgattgcgaaggcagcctgctggactgtaactgacgctgatgctcgaaagtgtgggtatcaaacaggattagataccctggtagtccacacagtaaacgatgaatactcgctgtttgcgatatacagtaagcggccaagcgaaagcgttaagtattccacctggggagtacgccggcaacggtgaaactcaaaggaattgacgggggcccgcacaagcggaggaacatgtggtttaattcgatgatacgcgaggaaccttacccgggcttgaattgcaactgaatgatgtggagacatgtcagccgcaaggcagttgtgaaggtgctgcatggttgtcgtcagctcgtgccgtgaggtgtcggcttaagtgccataacgagcgcaacccttatcgatagttaccatcaggttatgctggggactctgtcgagactgccgtcgtaagatgtgaggaaggtggggatgacgtcaaatcagcacggcccttacgtccggggctacacacgtgttacaatggggggtacagaaggcagctacacggcgacgtgatgctaatccctaaagcctctctcagttcggattggagtctgcaacccgactccatgaagctggattcgctagtaatcgcgcatcagccacggcgcggtgaatacgttcccgggccttgtacacaccgcccgtcaagccatgaaagccgggggtacctgaagtgcgtaaccgcaaggagcgccctagggtaaaactggtgattggggctaagtcgtaacaaggtagccgtaccggaaggtgcggctggaacacctcctttct

SEQ ID NO: 40 - DNA, 1533 bp, Artificial Sequence
  Bacteroides_sp_D22
ttacaatgaagagtttgatcctggctcaggatgaacgctagctacaggcttaacacatgcaagtcgaggggcagcattttagtttgcttgcaaactgaagatggcgaccggcgcacgggtgagtaacacgtatccaacctgccgataactcggggatagcctttcgaaagaaagattaatatccgatggtatattaaaaccgcatggttttactattaaagaatttcggttatcgatggggatgcgttccattagtttgttggcggggtaacggcccaccaagactacgatggataggggttctgagaggaaggtcccccacattggaactgagacacggtccaaactcctacgggaggcagcagtgaggaatattggtcaatggacgagagtctgaaccagccaagtagcgtgaaggatgactgccctatgggttgtaaacttcttttatatgggaataaagtattccacgtgtgggattttgtatgtaccatatgaataaggatcggctaactccgtgccagcagccgcggtaatacggaggatccgagcgttatccggatttattgggtttaaagggagcgtaggtggattgttaagtcagttgtgaaagtttgcggctcaaccgtaaaattgcagttgaaactggcagtcttgagtacagtagaggtgggcggaattcgtggtgtagcggtgaaatgcttagatatcacgaagaactccgattgcgaaggcagctcactagactgcaactgacactgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcaaatgaataatctggaaacaggttagccgcaaggcatttgtgaaggtgctgcatggttgtcgtcagctcgtgccgtgaggtgtcggcttaagtgccataacgagcgcaacccttatctttagttactaacaggtcatgctgaggactctagagagactgccgtcgtaagatgtgaggaaggtggggatgacgtcaaatcagcacggcccttacgtccggggctacacacgtgttacaatggggggtacagaaggcagctacctggcgacaggatgctaatcccaaaaacctctctcagttcggatcgaagtctgcaacccgacttcgtgaagctggattcgctagtaatcgcgcatcagccatggcgcggtgaatacgttcccgggccttgtacacaccgcccgtcaagccatgaaagccgggggtacctgaagtacgtaaccgcaaggagcgtcctagggtaaaactggtaattggggctaagtcgtaacaaggtagccgtaccggaaggtgcggctggaacacctcctttct

SEQ ID NO: 41 - DNA, 1528 bp, Artificial Sequence
  Bacteroides_sp_D2
ttacaatgaagagtttgatcctggctcaggatgaacgctagctacaggcttaacacatgcaagtcgaggggcagcatttttctagcaatagaagagatggcgaccggcgcacgggtgagtaacacgtatccaacctaccgataactccggaatagcctttcgaaagaaagattaataccggatagtatacgaatatcgcatgatatttttattaaagaatttcggttatcgatggggatgcgttccattagtttgttggcggggtaacggcccaccaagactacgatggataggggttctgagaggaaggtcccccacattggaactgagacacggtccaaactcctacgggaggcagcagtgaggaatattggtcaatgggcgcaggcctgaaccagccaagtagcgtgaaggatgaaggctctatgggtcgtaaacttcttttatatgggaataaagttttccacgtgtggaattttgtatgtaccatatgaataaggatcggctaactccgtgccagcagccgcggtaatacggaggatccgagcgttatccggatttattgggtttaaagggagcgtaggtggattgttaagtcagttgtgaaagtttgcggctcaaccgtaaaattgcagttgaaactggagtcttgagtacagtagaggtgggcggaattcgtggtgtagcggtgaaatgcttagatatcacgaagaactccgattgcgaaggcagctcactagactgttactgacactgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcaaatgaatatgtaggaaactatatagccgcaaggcatttgtgaaggtgctgcatggttgtcgtcagctcgtgccgtgaggtgtcggcttaagtgccataacgagcgcaacccttatctttagttactaacaggttatgctgaggactctagagagactgccgtcgtaagatgtgaggaaggtggggatgacgtcaaatcagcacggcccttacgtccggggctacacacgtgttacaatggggggtacagaaggcagctacacggcgacgtgatgctaatcccaaaaacctctctcagttcggatcgaagtctgcaacccgacttcgtgaagctggattcgctagtaatcgcgcatcagccatggcgcggtgaatacgttcccgggccttgtacacaccgcccgtcaagccatgaaagccgggggtacctgaagtacgtaaccgcaaggagcgtcctagggtaaaactggtaattggggctaagtcgtaacaaggtagccgtaccggaaggtgcggctggaacacctcctttct

SEQ ID NO: 42 - DNA, 1488 bp, Artificial Sequence
  Bacteroides_sp_F_4
agagtttgatcatggctcaggatgaacgctagctacaggcttaacacatgcaagtcgaggggcagcatgaacttagcttgctaagtttgatggcgaccggcgcacgggtgagtaacacgtatccaacctgccgatgactcggggatagcctttcgaaagaaagattaatacccgatggcatagttcttccgcatggtggaactattaaagaatttcggtcatcgatggggatgcgttccattaggttgttggcggggtaacggcccaccaagccttcgatggataggggttctgagaggaaggtcccccacattggaactgagacacggtccaaactcctacgggaggcagcagtgaggaatattggtcaatggacgagagtctgaaccagccaagtagcgtgaaggatgactgccctatgggtcgtaaacttcttttatacgggaataaagtgaggcacgtgtgcctttttgtatgtaccgtatgaataaggatcggctaactccgtgccagcagccgcggtaatacggaggatccgagcgttatccggatttattgggtttaaagggagcgtaggcggacgcttaagtcagttgtgaaagtttgcggctcaaccgtaaaattgcagttgatactgggtgtcttgagtacagtagaggcaggcggaattcgtggtgtagcggtgaaatgcttagatatcacgaagaactccgattgcgaaggcagcttgctggactgtaactgacgctgatgctcgaaagtgtgggtatcaaacaggattagataccctggtagtccacacagtaaacgatgaatactcgctgtttgcgatatacagtaagcggccaagcgaaagcgttaagtattccacctggggagtacgccggcaacggtgaaactcaaaggaattgacgggggcccgcacaagcggaggaacatgtggtttaattcgatgatacgcgaggaaccttacccgggcttgaattgcaactgaatgatgtggagacatgtcagccgcaaggcagttgtgaaggtgctgcatggttgtcgtcagctcgtgccgtgaggtgtcggcttaagtgccataacgagcgcaacccttatcgatagttaccatcaggttatgctggggactctgtcgagactgccgtcgtaagatgtgaggaaggtggggatgacgtcaaatcagcacggcccttacgtccggggctacacacgtgttacaatggggggtacagaaggcagctacacggcgacgtgatgctaatccctaaagcctctctcagttcggattggagtctgcaacccgactccatgaagctggattcgctagtaatcgcgcatcagccacggcgcggtgaatacgttcccgggccttgtacacaccgcccgtcaagccatgaaagccgggggtacctgaagtgcgtaaccgcaaggagcgccctagggtaaaactggtgattggggctaagtcgtaacaaggtagcc

SEQ ID NO: 43 - DNA, 1531 bp, Artificial Sequence
  Bacteroides_stercoris
ttacaatgaagagtttgatcctggctcaggatgaacgctagctacaggcttaacacatgcaagtcgaggggcagcatcatcaaagcttgctttgatggatggcgaccggcgcacgggtgagtaacacgtatccaacctgccgacaacactgggatagcctttcgaaagaaagattaataccggatggcatagttttcccgcatgggataattattaaagaatttcggttgtcgatggggatgcgttccattaggcagttggcggggtaacggcccaccaaaccaacgatggataggggttctgagaggaaggtcccccacattggaactgagacacggtccaaactcctacgggaggcagcagtgaggaatattggtcaatggacgagagtctgaaccagccaagtagcgtgaaggatgactgccctatgggttgtaaacttcttttatacgggaataaagtgagccacgtgtggctttttgtatgtaccgtatgaataaggatcggctaactccgtgccagcagccgcggtaatacggaggatccgagcgttatccggatttattgggtttaaagggagcgtaggcgggttgttaagtcagttgtgaaagtttgcggctcaaccgtaaaattgcagttgatactggcgaccttgagtgcaacagaggtaggcggaattcgtggtgtagcggtgaaatgcttagatatcacgaagaactccgattgcgaaggcagcttactggattgtaactgacgctgatgctcgaaagtgtgggtatcaaacaggattagataccctggtagtccacacagtaaacgatgaatactcgctgttggcgatatacagtcagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcaactgactgaatcggaaacggttctttcttcggacagttgtgaaggtgctgcatggttgtcgtcagctcgtgccgtgaggtgtcggcttaagtgccataacgagcgcaacccttacgggtagttaccatcaggttatgctggggactctacccggactgccgtcgtaagatgtgaggaaggtggggatgacgtcaaatcagcacggcccttacgtccggggctacacacgtgttacaatggggggtacagaaggcagctacacggcgacgtggtgctaatcccgaaagcctctctcagttcggattggagtctgcaacccgactccatgaagctggattcgctagtaatcgcgcatcagccacggcgcggtgaatacgttcccgggccttgtacacaccgcccgtcaagccatgaaagccgggggtacctgaagtacgtaaccgcgaggagcgtcctagggtaaaactggtgattggggctaagtcgtaacaaggtagccgtaccggaaggtgcggctggaacacctcctttct

SEQ ID NO: 44 - DNA, 1342 bp, Artificial Sequence
  Bacteroides_stercoris
  misc_feature (164)..(164): n is a, c, g, or t
  misc_feature (179)..(179): n is a, c, g, or t
  misc_feature (436)..(436): n is a, c, g, or t
  misc_feature (996)..(996): n is a, c, g, or t
atgaacgctagctacaggcttaacacatgcaagtcgaggggcagcatcatcaaagcttgctttgatggatggcgaccggcgcacgggtgagtaacacgtatccaacctgccgacaacactgggatagcctttcgaaagaaagattaataccggatggcatagtnttcccgcatgggatnattattaaagaatttcggttgtcgatggggatgcgttccattaggcagttggcggggtaacggcccaccaaacctacgatggataggggttctgagaggaaggtcccccacattggaactgagacacggtccaaactcctacgggaggcagcagtgaggaatattggtcaatggacgagagtctgaaccagccaagtagcgtgaaggatgactgccctatgggttgtaaacttcttttatacgggaataaagtgcangacgtgtggctttttgtatgtaccgtatgaataaggatcggctaactccgtgccagcagccgcggtaatacggaggatccgagcgttatccggatttattgggtttaaagggagcgtaggcgggttgttaagtcagttgtgaaagtttgcggctcaaccgtaaaattgcagttgatactggcgaccttgagtgcaacagaggtaggcggaattcgtggtgtagcggtgaaatgcttagatatcacgaagaactccgattgcgaaggcagcttactggattgtaactgacgctgatgctcgaaagtgtgggtatcaaacaggattagataccctggtagtccacacagtaaacgatgaatactcgctgttggcgatatacagtcagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcaactgactgaatcggaaacggttctttcnttcggacagttgtgaaggtgctgcatggttgtcgtcagctcgtgccgtgaggtgtcggcttaagtgccataacgagcgcaacccttacgggtagttaccatcaggttatgctggggactctacccggactgccgtcgtaagatgtgaggaaggtggggatgacgtcaaatcagcacggcccttacgtccggggctacacacgtgttacaatggggggtacagaaggcagctacacggcgacgtggtgctaatcccgaaagcctctctcagttcggattggagtctgcaacccgactccatgaagctggattcgctagtaatcgcgcatcagccacggcgcggtgaa

SEQ ID NO: 45 - DNA, 1326 bp, Artificial Sequence
  Bacteroides_uniformis
gagtttgatcctggctcaggatgaacgctagctacaggcttaacacatgcaagtcgagggaccggcgcacgggtgagtaacacgtatccaacctgccgatgactcggggatagcctttcgaaagaaagattaatacccgatggttaaagtcggtcattgatggggatgcgttccattaggttgttggcggggtaacggcccaccaagccgtcgatggataggggttctgagaggaaggtcccccacattggaactgagacacggtccaaactcctacgggaggcagcagtgaggaatattggtcaatggacgagagtctgaaccagccaagtagcgtgaaggatgactgcctatgggttgtaaacttcttttatacgggaatatgtatgtaccgtatgaataaggatcggctaactccgtgccagcagccgcggtaatacggaggatccgagcgttatccggatttattgggtttaaagggagcgtaggcggatgcttaagtcagttgtgaaagtttgcggctcaaccgtaaaattgcagttgatactgggtgtcttgagtacagtagaggcaggcggaattcgtggtgtagcggtgaaatgcttagatatcacgaagaactccgattgcgaaggcagcttgctggactgactgacgctgatgctcgaaagtgtgggtatcaaacaggattagataccctggtagtccacacagtaaacgatgaatactcgctgtttgcgagtaagcggccaagcgaaagcgttaagtattccacctggggagtacgccggcaacggtgaaactcaaaggaattgacgggggcccgcacaagcggaggaacatgtggtttaattcgatgatacgcgaggaaccttacccgggcttaaattgtgaaggtgctgcatggttgtcgtcagctcgtgccgtgaggtgtcggcttaagtgccataacgagcgcaacccttatcgatagttaccatcagctggggactctgtcgagactgccgtcgtaagatggaggaaggtggggatgacgtcaaatcagcacggcccttacgtccggggctacacacgtgttacaatggggggcagaaggcagctacacggtgacgtgatgctaatccctcctctctcagttcggatggagtctgcaacccgactccagaagctggattcgctagtaatcgcgcatcagccacggcgcggtgaatacgttcccgggccttgtacacaccgcccgtcaagccatgaaagccgggggtacctgaagtgcgtagcgccctagggtaaaactggtgattggggctaagtcgtaacaaggtaacc

SEQ ID NO: 46 - DNA, 1326 bp, Artificial Sequence
  Bacteroides_uniformis
gagtttgatcctggctcaggatgaacgctagctacaggcttaacacatgcaagtcgagggaccggcgcacgggtgagtaacacgtatccaacctgccgatgactcggggatagcctttcgaaagaaagattaatacccgatggttaaagtcggtcattgatggggatgcgttccattaggttgttggcggggtaacggcccaccaagccatcgatggataggggttctgagaggaaggtcccccacattggaactgagacacggtccaaactcctacgggaggcagcagtgaggaatattggtcaatggacgagagtctgaaccagccaagtagcgtgaaggatgactgcctatgggttgtaaacttcttttatacgggaatatgtatgtaccgtatgaataaggatcggctaactccgtgccagcagccgcggtaatacggaggatccgagcgttatccggatttattgggtttaaagggagcgtaggcggatgcttaagtcagttgtgaaagtttgcggctcaaccgtaaaattgcagttgatactgggtgtcttgagtacagtagaggcaggcggaattcgtggtgtagcggtgaaatgcttagatatcacgaagaactccgattgcgaaggcagcttgctggactgactgacgctgatgctcgaaagtgtgggtatcaaacaggattagataccctggtagtccacacagtaaacgatgaatactcgctgtttgcgagtaagcggccaagcgaaagcgttaagtattccacctggggagtacgccggcaacggtgaaactcaaaggaattgacgggggcccgcacaagcggaggaacatgtggtttaattcgatgatacgcgaggaaccttacccgggcttaaattgtgaaggtgctgcatggttgtcgtcagctcgtgccgtgaggtgtcggcttaagtgccataacgagcgcaacccttatcgatagttaccatcagctggggactctgtcgagactgccgtcgtaagatggaggaaggtggggatgacgtcaaatcagcacggcccttacgtccggggctacacacgtgttacaatggggggcagaaggcagctacacggtgacgtgatgctaatccctcctctctcagttcggatggagtctgcaacccgactccagaagctggattcgctagtaatcgcgcatcagccacggcgcggtgaatacgttcccgggccttgtacacaccgcccgtcaagccatgaaagccgggggtacctgaagtgcgtagcgccctagggtaaaactggtgattggggctaagtcgtaacaaggtaacc

SEQ ID NO: 47 - DNA, 1425 bp, Artificial Sequence
  Bacteroides_uniformis
gtttgatcatggctcaggatgaacgctagtacaggcttaacacatgcaagtcgaggggcagcatgaacttagcttgctaagtttgatggcgaccggcgcacgggtgagtaacacgtatccaacctgccgatgactcggggatagcctttcgaaagaaagattaatacccgatggcatagttcttccgcatggtagaactattaaagaatttcggtcatcgatggggatgcgttccattaggttgttggcggggtaacggcccaccaagccttcgatggataggggttctgagaggaaggtcccccacattggaactgagacacggtccaaactcctacgggaggcagcagtgaggaatattggtcaatggacgagagtctgaaccagccaagtagcgtgaaggatgactgccctatgggttgtaaacttcttttatacgggaataaagtgaggcacgtgtgcctttttgtatgtaccgtatgaataaggatcggctaactccgtgccagcagccgcggtaatacggaggatccgagcgttatccggatttattgggtttaaagggagcgtaggcggacgcttaagtcagttgtgaaagtttgcggctcaaccgtaaaattgcagttgatactgggtgtcttgagtacagtagaggcaggcggaattcgtggtgtagcggtgaaatgcttagatatcacgaagaactccgattgcgaaggcagcttgctggactgtaactgacgctgatgctcgaaagtgtgggtatcaaacaggattagataccctggtagtccacacagtaaacgatgaatactcgctgtttgcgatatacagtaagcggccaagcgaaagcgttaagtattccacctggggagtacgccggcaacggtgaaactcaaaggaattgacgggggcccgcacaagcggaggaacatgtggtttaattcgatgatacgcgaggaaccttacccgggcttgaattgcaactgaatgatgtggagacatgtcagccgcaaggcagttgtgaaggtgctgcatggttgtcgtcagctcgtgccgtgaggtgtcggcttaagtgccataacgagcgcaacccttatcgatagttaccatcaggttatgctggggactctgtcgagactgccgtcgtaagatgtgaggaaggtggggatgacgtcaaatcagcacggcccttacgtccggggctacacacgtgttacaatggggggtacagaaggcagctacacggcgacgtgatgctaatccctaaagcctctctcagttcggattggagtctgcaacccgactccatgaagctggattcgctagtaatcgcgcatcagccacggcgcggtgaatacgttcccgggccttgtacacaccgcccgtcaagccatgaaagccgggggtacctgaagtgcgtaa

SEQ ID NO: 48 - DNA, 1326 bp, Artificial Sequence
  Bacteroides_uniformis
gagtttgatcctggctcaggatgaacgctagctacaggcttaacacatgcaagtcgagggaccggcgcacgggtgagtaacacgtatccaacctgccgatgactcggggatagcctttcgaaagaaagattaatacccgatggctaaagtcggtcatcgatggggatgcgttccattaggttgttggcggggtaacggcccaccaagccttcgatggataggggttctgagaggaaggtcccccacattggaactgagacacggtccaaactcctacgggaggcagcagtgaggaatattggtcaatggacgagagtctgaaccagccaagtagcgtgaaggatgactgcctatgggttgtaaacttcttttatacgggaatatgtatgtaccgtatgaataaggatcggctaactccgtgccagcagccgcggtaatacggaggatccgagcgttatccggatttattgggtttaaagggagcgtaggcggacgcttaagtcagttgtgaaagtttgcggctcaaccgtaaaattgcagttgatactgggtgtcttgagtacagtagaggcaggcggaattcgtggtgtagcggtgaaatgcttagatatcacgaagaactccgattgcgaaggcagcttgctggactgactgacgctgatgctcgaaagtgtgggtatcaaacaggattagataccctggtagtccacacagtaaacgatgaatactcgctgtttgcgagtaagcggccaagcgaaagcgttaagtattccacctggggagtacgccggcaacggtgaaactcaaaggaattgacgggggcccgcacaagcggaggaacatgtggtttaattcgatgatacgcgaggaaccttacccgggcttgaattgtgaaggtgctgcatggttgtcgtcagctcgtgccgtgaggtgtcggcttaagtgccataacgagcgcaacccttatcgatagttaccatcagctggggactctgtcgagactgccgtcgtaagatggaggaaggtggggatgacgtcaaatcagcacggcccttacgtccggggctacacacgtgttacaatggggggcagaaggcagctacacggcgacgtgatgctaatcccgcctctctcagttcggatggagtctgcaacccgactccagaagctggattcgctagtaatcgcgcatcagccacggcgcggtgaatacgttcccgggccttgtacacaccgcccgtcaagccatgaaagccgggggtacctgaagtgcgtagcgccctagggtaaaactggtgattggggctaagtcgtaacaaggtaacc

SEQ ID NO: 49 - DNA, 1323 bp, Artificial Sequence
  Bacteroides_uniformis
gagtttgatcctggctcaggatgaacgctagctacaggcttaacacatgcaagtcgagggaccggcgcacgggtgagtaacacgtatccaacctgccgatgactcggggatagcctttcgaaagaaagattaatacccgatggttaaagtcggtcattgatggggatgcgttccattaggttgttggcggggtaacggcccaccaagccatcgatggataggggttctgagaggaaggtcccccacattggaactgagacacggtccaaactcctacgggaggcagcagtgaggaatattggtcaatggacgagagtctgaaccagccaagtagcgtgaaggatgactgcctatgggttgtaaacttcttttatacgggaatatgtatgtaccgtatgaataaggatcggctaactccgtgccagcagccgcggtaatacggaggatccgagcgttatccggatttattgggtttaaagggagcgtaggcggatgcttaagtcagttgtgaaagtttgcggctcaaccgtaaaattgcagttgatactgggtgtcttgagtacagtagaggcaggcggaattcgtggtgtagcggtgaaatgcttagatatcacgaagaactccgattgcgaaggcagcttgctggactgactgacgctgatgctcgaaagtgtgggtatcaaacaggattagataccctggtagtccacacagtaaacgatgaatactcgctgtttgcgagtaagcggccaagcgaaagcgttaagtattccacctggggagtacgccggcaacggtgaaactcaaaggaattgacgggggcccgcacaagcggaggaacatgtggtttaattcgatgatacgcgaggaaccttacccgggcttaaattgtgaaggtgctgcatggttgtcgtcagctcgtgccgtgaggtgtcggcttaagtgcaacgagcgcaacccttatcgatagttaccatcagctggggactctgtcgagactgccgtcgtaagatggaggaaggtggggatgacgtcaaatcagcacggcccttacgtccggggctacacacgtgttacaatggggggcagaaggcagctacacggtgacgtgatgctaatccctcctctctcagttcggatggagtctgcaacccgactccagaagctggattcgctagtaatcgcgcatcagccacggcgcggtgaatacgttcccgggccttgtacacaccgcccgtcaagccatgaaagccgggggtacctgaagtgcgtagcgccctagggtaaaactggtgattggggctaagtcgtaacaaggtaacc

SEQ ID NO: 50 - DNA, 1326 bp, Artificial Sequence
  Bacteroides_uniformis
gagtttgatcctggctcaggatgaacgctagctacaggcttaacacatgcaagtcgagggaccggcgcacgggtgagtaacacgtatccaacctgccgatgactcggggatagcctttcgaaagaaagattaatacccgatggctaaagtcggtcatcgatggggatgcgttccattaggttgttggcggggtaacggcccaccaagccttcgatggataggggttctgagaggaaggtcccccacattggaactgagacacggtccaaactcctacgggaggcagcagtgaggaatattggtcaatggacgagagtctgaaccagccaagtagcgtgaaggatgactgcctatgggttgtaaacttcttttatacgggaatatgtatgtaccgtatgaataaggatcggctaactccgtgccagcagccgcggtaatacggaggatccgagcgttatccggatttattgggtttaaagggagcgtaggcggacgcttaagtcagttgtgaaagtttgcggctcaaccgtaaaattgcagttgatactgggtgtcttgagtacagtagaggcaggcggaattcgtggtgtagcggtgaaatgcttagatatcacgaagaactccgattgcgaaggcagcttgctggactgactgacgctgatgctcgaaagtgtgggtatcaaacaggattagataccctggtagtccacacagtaaacgatgaatactcgctgtttgcgagtaagcggccaagcgaaagcgttaagtattccacctggggagtacgccggcaacggtgaaactcaaaggaattgacgggggcccgcacaagcggaggaacatgtggtttaattcgatgatacgcgaggaaccttacccgggcttgaattgtgaaggtgctgcatggttgtcgtcagctcgtgccgtgaggtgtcggcttaagtgccataacgagcgcaacccttatcgatagttaccatcagctggggactctgtcgagactgccgtcgtaagatggaggaaggtggggatgacgtcaaatcagcacggcccttacgtccggggctacacacgtgttacaatggggggcagaaggcagctacacggcgacgtgatgctaatccctcctctctcagttcggatggagtctgcaacccgactccagaagctggattcgctagtaatcgcgcatcagccacggcgcggtgaatacgttcccgggccttgtacacaccgcccgtcaagccatgaaagccgggggtacctgaagtgcgtagcgccctagggtaaaactggtgattggggctaagtcgtaacaaggtaacc

SEQ ID NO: 51 - DNA, 1240 bp, Artificial Sequence
  Bacteroides_uniformis
caggcttaacacatgcaagtcgagggaccggcgcacgggtgagtaacacgtatccaacctgccgatgactcggggatagcctttcgaaagaaagattaatacccgatggctaaagtcggtcatcgatggggatgcgttccattaggttgttggcggggtaacggcccaccaagccttcgatggataggggttctgagaggaaggtcccccacattggaactgagacacggtccaaactcctacgggaggcagcagtgaggaatattggtcaatggacgagagtctgaaccagccaagtagcgtgaaggatgactgcctatgggttgtaaacttcttttatacgggaatatgtatgtaccgtatgaataaggatcggctaactccgtgccagcagccgcggtaatacggaggatccgagcgttatccggatttattgggtttaaagggagcgtaggcggacgcttaagtcagttgtgaaagtttgcggctcaaccgtaaaattgcagttgatactgggtgtcttgagtacagtagaggcaggcggaattcgtggtgtagcggtgaaatgcttagatatcacgaagaactccgattgcgaaggcagcttgctggactgactgacgctgatgctcgaaagtgtgggtatcaaacaggattagataccctggtagtccacacagtaaacgatgaatactcgctgtttgcgagtaagcggccaagcgaaagcgttaagtattccacctggggagtacgccggcaacggtgaaactcaaaggaattgacgggggcccgcacaagcggaggaacatgtggtttaattcgatgatacgcgaggaacttacccgggcttgaattgtgaaggtgctgcatggttgtcgtcagctcgtgccgtgaggtgtcggcttaagtgccataacgagcgcaacccttatcgatagttaccatcagctggggactctgtcgagactgccgtccgtaagatggaggaaggtggggatgacgtcaaatcagcacggcccttacgtccggggctacacacgtgttacaatggggggcagaaggcagctacacggcgacgtgatgctaatccctcctctctcagttcggatggagtctgcaacccgactccagaagctggattcgctagtaatcgcgcatcagccacagcgcggtgaatacgtcccgggccttgtacacaccgcccgtcaagccatgaaaccgggggtacctgaagtgcgta

SEQ ID NO: 52 - DNA, 1305 bp, Artificial Sequence
  Bacteroides_uniformis
tttgatcatggctcaggatgaacgctagctacaggcttaacacatgcaagtcgagggaccggcgcacgggtgagtaacacgtatccaacctgccgatgactcggggatagcctttcgaaagaaagattaatacccgatggctaaagtcggtcatcgatggggatgcgttccattaggttgttggcggggtaacggcccaccaagccttcgatggataggggttctgagaggaaggtcccccacattggaactgagacacggtccaaactcctacgggaggcagcagtgaggaatattggtcaatggacgagagtctgaaccagccaagtagcgtgaaggatgactgcctatgggttgtaaacttcttttatacgggaatatgtatgtaccgtatgaataaggatcggctaactccgtgccagcagccgcggtaatacggaggatccgagcgttatccggatttattgggtttaaagggagcgtaggcggacgcttaagtcagttgtgaaagtttgcggctcaaccgtaaaattgcagttgatactgggtgtcttgagtacagtagaggcaggcggaattcgtggtgtagcggtgaaatgcttagatatcacgaagaactccgattgcgaaggcagcttgctggactgactgacgctgatgctcgaaagtgtgggtatcaaacaggattagataccctggtagtccacacagtaaacgatgaatactcgctgtttgcgagtaagcggccaagcgaaagcgttaagtattccacctggggagtacgccggcaacggtgaaactcaaaggaattgacgggggcccgcacaagcggaggaacatgtggtttaattcgatgatacgcgaggaacttacccgggcttgaattgtgaaggtgctgcatggttgtcgtcagctcgtgccgtgaggtgtcggcttaagtgccataacgagcgcaacccttatcgatagttaccatcagctggggactctgtcgagactgccgtcgtaagatggaggaaggtggggatgacgtcaaatcagcacggcccttacgtccggggctacacacgtgttacaatggggggcagaaggcagctacacggcgacgtgatgctaatccctcctctctcagttcggatggagtctgcaacccgactccagaagctggattcgctagtaatcgcgcatcagccacggcgcggtgaatacgttcccgggccttgtacacaccgcccgtcaagccatgaaagccgggggtacctgaagtgcgtagcgccctagggtaaaactggtgattggggctaa

SEQ ID NO: 53 - DNA, 1510 bp, Artificial Sequence
  Bacteroides_vulgatus
tattacaatgaagagtttgatcctggctcaggatgaacgctagctacaggcttaacacatgcaagtcgaggggcagcatggtcttagcttgctaagactgatggcgaccggcgcacgggtgagtaacacgtatccaacctgccgtctactcttggacagccttctgaaaggaagattaatacaagatggcatcatgagtccgcatgttcacatgattaaaggtattccggtagacgatggggatgcgttccattagatagtaggcggggtaacggcccacctagtcttcgatggataggggttctgagaggaaggtcccccacattggaactgagacacggtccaaactcctacgggaggcagcagtgaggaatattggtcaatgggcgcaggcctgaaccagccaagtagcgtgaaggatgactgccctatgggttgtaaacttcttttataaaggaataaagtcgggtatggatacccgtttgcatgtactttatgaataaggatcggctaactccgtgccagcagccgcggtaatacggaggatccgagcgttatccggatttattgggtttaaagggagcgtagatggatgtttaagtcagttgtgaaagtttgcggctcaaccgtaaaattgcagttgatactggatatcttgagtgcagttgaggcaggcggaattcgtggtgtagcggtgaaatgcttagatatcacgaagaactccgattgcgaaggcagcctgctaagctgcaactgacattgaggctcgaaagtgtgggtatcaaacaggattagataccctggtagtccacacggtaaacgatgaatactcgctgtttgcgatatacggcaagcggccaagcgaaagcgttaagtattccacctggggagtacgccggcaacggtgaaactcaaaggaattgacgggggcccgcacaagcggaggaacatgtggtttaattcgatgatacgcgaggaaccttacccgggcttaaattgcagatgaattacggtgaaagccgtaagccgcaaggcatctgtgaaggtgctgcatggttgtcgtcagctcgtgccgtgaggtgtcggcttaagtgccataacgagcgcaacccttgttgtcagttactaacaggtttcgctgaggactctgacaagactgccatcgtaagatgtgaggaaggtggggatgacgtcaaatcagcacggcccttacgtccggggctacacacgtgttacaatggggggtacagagggccgctaccacgcgagtggatgccaatcccaaaaacctctctcagttcggactggagtctgcaacccgactccacgaagctggattcgctagtaatcgcgcatcagccacggcgcggtgaatacgttcccgggccttgtacacaccgcccgtcaagccatgggagccgggggtacctgaagtgcgtaaccgcgaggagcgccctagggtaaaactggtgactggggctaagtcgtaacaaggtagccgtaccggaag

SEQ ID NO: 54 - DNA, 1374 bp, Artificial Sequence
  Bacteroides_vulgatus
tctgaaaggaagattaatacaagatggcatcatgagtccgcatgttcacatgattaaaggtattccggtagacgatggggatgcgttccattagatagtaggcggggtaacggcccacctagtcttcgatggataggggttctgagaggaaggtcccccacattggaactgagacacggtccaaactcctacgggaggcagcagtgaggaatattggtcaatgggcgagagcctgaaccagccaagtagcgtgaaggatgactgccctatgggttgtaaacttcttttataaaggaataaagtcgggtatgtatacccgtttgcatgtactttatgaataaggatcggctaactccgtgccagcagccgcggtaatacggaggatccgagcgttatccggatttattgggtttaaagggagcgtagatggatgtttaagtcagttgtgaaagtttgcggctcaaccgtaaaattgcagttgatactggatatcttgagtgcagttgaggcaggcggaattcgtggtgtagcggtgaaatgcttagatatcacgaagaactccgattgcgaaggcagcctgctaagctgcaactgacattgaggctcgaaagtgtgggtatcaaacaggattagataccctggtagtccacacggtaaacgatgaatactcgctgtttgcgatatactgcaagcggccaagcgaaagcgttaagtattccacctggggagtacgccggcaacggtgaaactcaaaggaattgacgggggcccgcacaagcggaggaacatgtggtttaattcgatgatacgcgaggaaccttacccgggcttaaattgcagatgaattacggtgaaagccgtaagccgcaaggcatctgtgaaggtgctgcatggttgtcgtcagctcgtgccgtgaggtgtcggcttaagtgccataacgagcgcaacccttgttgtcagttactaacaggttccgctgaggactctgacaagactgccatcgtaagatgtgaggaaggtggggatgacgtcaaatcagcacggcccttacgtccggggctacacacgtgttacaatggggggtacagagggccgctaccacgcgagtggatgccaatccccaaaacctctctcagttcggactggagtctgcaacccgactccacgaagctggattcgctagtaatcgcgcatcagccacggcgcggtgaatacgttcccgggccttgtacacaccgcccgtcaagccatgggagccgggggtacctgaagtgcgtaaccgcgaggagcgccctagggtaaaactggtgactggggctaagtcgtaacaaggtagccgtaccggaaggtgcggctggaacacctccttctgaa

SEQ ID NO: 55 - DNA, 1508 bp, Artificial Sequence
  Bacteroides_vulgatus
agagtttgatcctggctcaggatgaacgctagctacaggcttaacacatgcaagtcgaggggcagcatggtcttagcttgctaaggccgatggcgaccggcgcacgggtgagtaacacgtatccaacctgccgtctactcttggacagccttctgaaaggaagattaatacaagatggcatcatgagtccgcatgttcacatgattaaaggtattccggtagacgatggggatgcgttccattagatagtaggcggggtaacggcccacctagtcttcgatggataggggttctgagaggaaggtcccccacattggaactgagacacggtccaaactcctacgggaggcagcagtgaggaatattggtcaatgggcgagagcctgaaccagccaagtagcgtgaaggatgactgccctatgggttgtaaacttcttttataaaggaataaagtcgggtatgtatacccgtttgcatgtactttatgaataaggatcggctaactccgtgccagcagccgcggtaatacggaggatccgagcgttatccggatttattgggtttaaagggagcgtagatggatgtttaagtcagttgtgaaagtttgcggctcaaccgtaaaattgcagttgatactggatatcttgagtgcagttgaggcaggcggaattcgtggtgtagcggtgaaatgcttagatatcacgaagaactccgattgcgaaggcagcctgctaagctgcaactgacattgaggctcgaaagtgtgggtatcaaacaggattagataccctggtagtccacacggtaaacgatgaatactcgctgtttgcgatatactgcaagcggccaagcgaaagcgttaagtattccacctggggagtacgccggcaacggtgaaactcaaaggaattgacgggggcccgcacaagcggaggaacatgtggtttaattcgatgatacgcgaggaaccttacccgggcttaaattgcagatgaattacggtgaaagccgtaagccgcaaggcatctgtgaaggtgctgcatggttgtcgtcagctcgtgccgtgaggtgtcggcttaagtgccataacgagcgcaacccttgttgtcagttactaacaggttccgctgaggactctgacaagactgccatcgtaagatgtgaggaaggtggggatgacgtcaaatcagcacggcccttacgtccggggctacacacgtgttacaatggggggtacagagggccgctaccacgcgagtggatgccaatccccaaaacctctctcagttcggactggagtctgcaacccgactccacgaagctggattcgctagtaatcgcgcatcagccacggcgcggtgaatacgttcccgggccttgtacacaccgcccgtcaagccatgggagccgggggtacctgaagtgcgtaaccgcgaggagcgccctagggtaaaactggtgactggggctaagtcgtaacaaggtagccgtaccggaaggtgcggctg

SEQ ID NO: 56 - DNA, 1465 bp, Artificial Sequence
  Bacteroides_xylanisolvens
gctcaggatgaacgctagctacaggcttaacacatgcaagtcgaggggcagcattttagtttgcttgcaaactaaagatggcgaccggcgcacgggtgagtaacacgtatccaacctgccgataactcggggatagcctttcgaaagaaagattaatatccgatagtatattaaaaccgcatggttttactattaaagaatttcggttatcgatggggatgcgttccattagtttgttggcggggtaacggcccaccaagactacgatggataggggttctgagaggaaggtcccccacattggaactgagacacggtccaaactcctacgggaggcagcagtgaggaatattggtcaatggacgagagtctgaaccagccaagtagcgtgaaggatgactgccctatgggttgtaaacttcttttatatgggaataaagtattccacgtgtggrattttgtatgtaccatatgaataaggatcggctaactccgtgccagcagccgcggtaatacggaggatccgagcgttatccggatttattgggtttaaagggagcgtaggtggattgttaagtcagttgtgaaagtttgcggctcaaccgtaaaattgcagttgaaactggcagtcttgagtacagtagaggtgggcggaattcgtggtgtagcggtgaaatgcttagatatcacgaagaactccgattgcgaaggcagctcactagactgcaactgacactgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcaaatgaataatctggaaacaggttagccgcaaggcatttgtgaaggtgctgcatggttgtcgtcagctcgtgccgtgaggtgtcggcttaagtgccataacgagcgcaacccttatctttagttactaacaggttatgctgaggactctagagagactgccgtcgtaagatgtgaggaaggtggggatgacgtcaaatcagcacggcccttacgtccggggctacacacgtgttacaatggggggtacagaaggcagctacctggcgacaggatgctaatcccaaaaacctctctcagttcggatcgaagtctgcaacccgacttcgtgaagctggattcgctagtaatcgcgcatcagccatggcgcggtgaatacgttcccgggccttgtacacaccgcccgtcaagccatgaaagccgggggtacctgaagtacgtaaccgcaaggagcgtcctagggtaaaactggtaattggggctaagtcgta

SEQ ID NO: 57 - DNA, 1508 bp, Artificial Sequence
  Bacteroides_xylanisolvens
agagtttgatcctggctcaggatgaacgctagctacaggcttaacacatgcaagtcgaggggcagcattttagtttgcttgcaaactaaagatggcgaccggcgcacgggtgagtaacacgtatccaacctgccgataactcggggatagcctttcgaaagaaagattaatatccgatagtatattaaaccgcatggttttactattaaagaatttcggttatcgatggggatgcgttccattagtttgttggcggggtaacggcccaccaagactacgatggataggggttctgagaggaaggtcccccacattggaactgagacacggtccaaactcctacgggaggcagcagtgaggaatattggtcaatggacgagagtctgaaccagccaagtagcgtgaaggatgactgccctatgggttgtaaacttcttttatatgggaataaagtattccacgtgtggaattttgtatgtaccatatgaataaggatcggctaactccgtgccagcagccgcggtaatacggaggatccgagcgttatccggatttattgggtttaaagggagcgtaggtggattgttaagtcagttgtgaaagtttgcggctcaaccgtaaaattgcagttgaaactggcagtcttgagtacagtagaggtgggcggaattcgtggtgtagcggtgaaatgcttagatatcacgaagaactccgattgcgaaggcagctcactagactgcaactgacactgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcatttgaataatctggaaacaggttagccgcaaggcaaatgtgaaggtgctgcatggttgtcgtcagctcgtgccgtgaggtgtcggcttaagtgccataacgagcgcaacccttatctttagttactaacaggtcatgctgaggactctagagagactgccgtcgtaagatgtgaggaaggtggggatgacgtcaaatcagcacggcccttacgtccggggctacacacgtgttacaatggggggtacagaaggcagctacctggcgacaggatgctaatcccaaaaacctctctcagttcggatcgaagtctgcaacccgacttcgtgaagctggattcgctagtaatcgcgcatcagccatggcgcggtgaatacgttcccgggccttgtacacaccgcccgtcaagccatgaaagccgggggtacctgaagtacgtaaccgcaaggagcgtcctagggtaaaactggtaattggggctaagtcgtaacaaggtagccgtaccggaaggtgcggctg

SEQ ID NO: 58 - DNA, 1368 bp, Artificial Sequence
  Bacteroides_xylanisolvens
catgcaagtcgaggggcagcattttagtttgcttgcaaactaaagatggcgaccggcgcacgggtgagtaacacgtatccaacctgccgataactcggggatagcctttcgaaagaaagattaatatccgatagtatattaaaaccgcatggttttactattaaagaatttcggttatcgatggggatgcgttccattagtttgttggcggggtaacggcccaccaagactacgatggataggggttctgagaggaaggtcccccacattggaactgagacacggtccaaactcctacgggaggcagcagtgaggaatattggtcaatggacgagagtctgaaccagccaagtagcgtgaaggatgactgccctatgggttgtaaacttcttttatatgggaataaagtattccacgtgtgggattttgtatgtaccatatgaataaggatcggctaactccgtgccagcagccgcggtaatacggaggatccgagcgttatccggatttattgggtttaaagggagcgtaggtggattgttaagtcagttgtgaaagtttgcggctcaaccgtaaaattgcagttgaaactggcagtcttgagtacagtagaggtgggcggaattcgtggtgtagcggtgaaatgcttagatatcacgaagaactccgattgcgaaggcagctcactagactgcaactgacactgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcaaatgaataatctggaaacaggttagccgcaaggcatttgtgaaggtgctgcatggttgtcgtcagctcgtgccgtgaggtgtcggcttaagtgccataacgagcgcaacccttatctttagttactaacaggttatgctgaggactctagagagactgccgtcgtaagatgtgaggaaggtggggatgacgtcaaatcagcacggcccttacgtccggggctacacacgtgttacaatggggggtacagaaggcagctacctggcgacaggatgctaatcccaaaaacctctctcagttcggatcgaagtctgcaacccgacttcgtgaagctggattcgctagtaatcgcgcatcagccatggcgcggtgaatacgttcccgggccttgtacacaccgcccgtcaagccatgaaagccgggg

SEQ ID NO: 59 - DNA, 1316 bp, Artificial Sequence
  Barnesiella_intestinihominis
gatgaacgctagcgacaggcctaacacatgcaagtcgagggaccggcgcacgggtgagtaacacgtatgcaatccacctgtaacagggggataacccggagaaatccggactaataccccataattaaagttggttacagacgagcatgcgctccattagccagttggcggggtaacggcccaccaaagcgacgatggataggggttctgagaggaaggtcccccacattggaactgagacacggtccaaactcctacgggaggcagcagtgaggaatattggtcaatggtcggcagactgaaccagccaagtcgcgtgagggaagacggcctacgggttgtaaacctcttttgtcggagagtatgcaagtatccgaagaaaaagcatcggctaactccgtgccagcagccgcggtaatacggaggatgcgagcgttatccggatttattgggtttaaagggtgcgtaggcggcacgccaagtcagcggtgaaatttccgggctcaacccggagtgtgccgttgaaactggcgagctagagtacacaagaggcaggcggaatgcgtggtgtagcggtgaaatgcatagatatcacgcagaaccccgattgcgaaggcagcctgctagggtgacagacgctgaggcacgaaagcgtgggtatcgaacaggattagataccctggtagtccacgcagtaaacgatgaatactaactgtttgcgtgtaagcggtacagcgaaagcgttaagtattccacctggggagtacgccggcaacggtgaaactcaaaggaattgacgggggcccgcacaagcggaggaacatgtggtttaattcgatgatacgcgaggaaccttacccgggctcaaacgcgaggtgctgcatggttgtcgtcagctcgtgccgtgaggtgtcggcttaagtgccataacgagcgcaacccctatcgacagttactaacggccgaggactctgtcgagactgccggcgcaagccggaggaaggtggggatgacgtcaaatcagcacggcccttacgtccggggcgacacacgtgttacaatggcaggcagaaggcagccagtcagcaatgacgcgcgaatcccgcctgtctcagttcggatggagtctgcaacccgactccagaagctggattcgctagtaatcgcgcatcagccatggcgcggtgaatacgttcccgggccttgtacacaccgcccgtcaagccatggaagccgggagtacctgaagcatgcagcgtacgaaggtaataccggtaactggggctaagtcgtaacaaggtagccgtaccggaagg

SEQ ID NO: 60 - DNA, 1536 bp, Artificial Sequence
  Bifidobacterium_adolescentis
tttttgtggagggttcgattctggctcaggatgaacgctggcggcgtgcttaacacatgcaagtcgaacgggatcggctggagcttgctccggccgtgagagtggcgaacgggtgagtaatgcgtgaccgacctgccccatacaccggaatagctcctggaaacgggtggtaatgccggatgctccagttggatgcatgtccttctgggaaagattctatcggtatgggatggggtcgcgtcctatcagcttgatggcggggtaacggcccaccatggcttcgacgggtagccggcctgagagggcgaccggccacattgggactgagatacggcccagactcctacgggaggcagcagtggggaatattgcacaatgggcgcaagcctgatgcagcgacgccgcgtgcgggatgacggccttcgggttgtaaaccgcttttgactgggagcaagcccttcggggtgagtgtacctttcgaataagcaccggctaactacgtgccagcagccgcggtaatacgtagggtgcaagcgttatccggaattattgggcgtaaagggctcgtaggcggttcgtcgcgtccgggtgtgaaagtccatcgcttaacggtggatccgcgccgggtacgggcgggcttgagtgcggtaggggagactggaattcccggtgtaacggtggaatgtgtagatatcgggaagaacaccaatggcgaaggcaggtctctgggccgtcactgacgctgaggagcgaaagcgtggggagcgaacaggattagataccctggtagtccacgccgtaaacggtggatgctggatgtggggaccattccacggtctccgtgtcggagccaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgacagccgtagagatacggtttcccttcggggcgggttcacaggtggtgcatggtcgtcgtcagctcgtgtcgtgagatgttgggttaagccccgcaacgagcgcaaccctcgccctgtgttgccagcacgtcgtggtgggaactcacgggggaccgccggggtcaactcggaggaaggtggggatgacgtcagatcatcatgccccttacgtccagggcttcacgcatgctacaatggccggtacaacgggatgcgacaccgcgaggtggagcggatcccttaaaaccggtctcagttcggattggagtctgcaacccgactccatgaaggcggagtcgctagtaatcgcggatcagcaacgccgcggtgaatgcgttcccgggccttgtacacaccgcccgtcaagtcatgaaagtgggtagcacccgaagccggtggcccaaccttttttggggggagccgtctaaggtgagactcgtgattgggactaagtcgtaacaaggtagccgtaccggaaggtgcggctggatcacctcctttct

SEQ ID NO: 61 - DNA, 1438 bp, Artificial Sequence
  Bifidobacterium_adolescentis
aggacgctggcggcgtgcttacacatgcagtcgaacgggatcccaggagcttgctcctgggtgagagtggcgaacgggtgagtaatgcgtgaccgacctgccccatacaccggaatagctcctggaaacgggtggtaatgccggatgctccgacatgacgcatgtcgtgtcgggaaagattcatcggtatgggatggggtcgcgtcctatcagcttgatggcggggtaacggcccaccatggcttcgacgggtagccggcctgagagggcgaccggccacattgggactgagatacggcccagactcctacgggaggcagcagtggggaatattgcacaatgggcgcaagcctgatgcagcgacgccgcgtgcgggatgacggccttcgggttgtaaaccgcttttgactgggagcaagcccttcggggtgagtgtacctttcgaataagcaccggctaactacgtgccagcagccgcggtaatacgtagggtgcaagcgttatccggaattattgggcgtaaagggctcgtaggcggttcgtcgcgtccggtgtgaaagtccatcgcttaacggtggatccgcgccgggtacgggcgggcttgagtgcggtaggggagactggaattcccggtgtaacggtggaatgtgtagatatcgggaagaacaccaatggcgaaggcaggtctctgggccgtcactgacgctgaggagcgaaagcgtggggagcgaacaggattagataccctggtagtccacgccgtaaacggtggatgctggatgtggggaccattccacggtctccgtgtcggagccaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgacagccccagagatggggcctcccttcggggcgggttcacaggtggtgcatggtcgtcgtcagctcgtgtcgtgagatgttgggttaagtcccgcaacgagcgcaaccctcgccctgtgttgccagcacgtcgtggtgggaactcacgggggaccgccggggtcaactcggaggaaggtggggatgacgtcagatcatcatgccccttacgtccagggcttcacgcatgctacaatggccggtacaacgggatgcgacaccgcgaggtggagcggatcccttaaaaccggtctcagttcggattggagtctgcaacccgactccatgaaggcggagtcgctagtaatcgcggatcagcaacgccgcggtgaatgcgttcccgggccttgtacacaccgcccgtcaagtcatgaaagtgggtagcacccgaagccggtggcccaaccttttggggggagccgtctaagggagactccgatggc

SEQ ID NO: 62 - DNA, 1536 bp, Artificial Sequence
  Bifidobacterium_adolescentis
tttttgtggagggttcgattctggctcaggatgaacgctggcggcgtgcttaacacatgcaagtcgaacgggatcccaggagcttgctcctgggtgagagtggcgaacgggtgagtaatgcgtgaccgacctgccccatacaccggaatagctcctggaaacgggtggtaatgccggatgctccagttggatgcatgtccttctgggaaagattcatcggtatgggatggggtcgcgtcctatcagcttgatggcggggtaacggcccaccatggcttcgacgggtagccggcctgagagggcgaccggccacattgggactgagatacggcccagactcctacgggaggcagcagtggggaatattgcacaatgggcgcaagcctgatgcagcgacgccgcgtgcgggatgacggccttcgggttgtaaaccgcttttgactgggagcaagcccttcggggtgagtgtacctttcgaataagcaccggctaactacgtgccagcagccgcggtaatacgtagggtgcaagcgttatccggaattattgggcgtaaagggctcgtaggcggttcgtcgcgtccggtgtgaaagtccatcgcttaacggtggatccgcgccgggtacgggcgggcttgagtgcggtaggggagactggaattcccggtgtaacggtggaatgtgtagatatcgggaagaacaccaatggcgaaggcaggtctctgggccgtcactgacgctgaggagcgaaagcgtggggagcgaacaggattagataccctggtagtccacgccgtaaacggtggatgctggatgtggggaccattccacggtctccgtgtcggagccaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgacagccgtagagatacggtctcccttcggggcgggttcacaggtggtgcatggtcgtcgtcagctcgtgtcgtgagatgttgggttaagtcccgcaacgagcgcaaccctcgccctgtgttgccagcacgtcgtggtgggaactcacgggggaccgccggggtcaactcggaggaaggtggggatgacgtcagatcatcatgccccttacgtccagggcttcacgcatgctacaatggccggtacaacgggatgcgacaccgcgaggtggagcggatcccttaaaaccggtctcagttcggattggagtctgcaacccgactccatgaaggcggagtcgctagtaatcgcggatcagcaacgccgcggtgaatgcgttcccgggccttgtacacaccgcccgtcaagtcatgaaagtgggtagcacccgaagccggtggcccaaccttttggggggagccgtctaaggtgagactcgtgattgggactaagtcgtaacaaggtagccgtaccggaaggtgcggctggatcacctcctttctacggag

SEQ ID NO: 63 - DNA, 1295 bp, Artificial Sequence
  Bifidobacterium_adolescentis
gatgaacgctggcggcgtgcttaacacatgcaagtcgaacgagtggcgaacgggtgagtaatgcgtgaccgacctgccccatacaccggaatagctcctggaaacgggtggtaatgccggatgctgaaagtcggtatgggatggggtcgcgtcctatcagcttgatggcggggtaacggcccaccatggcttcgacgggtagccggcctgagagggcgaccggccacattgggactgagatacggcccagactcctacgggaggcagcagtggggaatattgcacaatgggcgcaagcctgatgcagcgacgccgcgtgcgggatgacggccttcgggttgtaaaccgcttttgactgggagcatgagtgtacctttcgaataagcaccggctaactacgtgccagcagccgcggtaatacgtagggtgcaagcgttatccggaattattgggcgtaaagggctcgtaggcggttcgtcgcgtccggtgtgaaagtccatcgcttaacggtggatccgcgccgggtacgggcgggcttgagtgcggtaggggagactggaattcccggtgtaacggtggaatgtgtagatatcgggaagaacaccaatggcgaaggcaggtctctgggccgactgacgctgaggagcgaaagcgtggggagcgaacaggattagataccctggtagtccacgccgtaaacggtggatgctggatgtggggatctccgtgtcggagccaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgcacaggtggtgcatggtcgtcgtcagctcgtgtcgtgagatgttgggttaagtcccgcaacgagcgcaaccctcgccctgtgttgccagcacgtgggaactcacgggggaccgccggggtcaactcggaggaaggtggggatgacgtcagatcatcatgccccttacgtccagggcttcacgcatgctacaatggccggcaacgggatgcgacaccgcgaggtggagcggatcccttccggtctcagttcggatggagtctgcaacccgactccagaaggcggagtcgctagtaatcgcggatcagcaacgccgcggtgaatgcgttcccgggccttgtacacaccgcccgtcaagtcatgaaagtgggtagcacccgaagccggtgcccagggagccgtctaaggtgagactcgtgattggg

SEQ ID NO: 64 - DNA, 1535 bp, Artificial Sequence
  Bifidobacterium_angulatum
tttttgtggagggttcgattctggctcaggatgaacgctggcggcgtgcttaacacatgcaagtcgaacgggatcggctggagcttgctccggccgtgagagtggcgaacgggtgagtaatgcgtgaccgacctgccccgtacaccggaatagctcctggaaacgggtggtaatgccggatgctccagtccatcgcatggtggtctgggaaagattttatcggtatgggatggggtcgcgtcctatcaggtagtcggcggggtaacggcccaccgagcctacgacgggtagccggcctgagagggcgaccggccacattgggactgagatacggcccagactcctacgggaggcagcagtggggaatattgcacaatgggcgcaagcctgatgcagcgacgccgcgtgcgggatgacggccttcgggttgtaaaccgcttttgttggggagcaagccttcgggtgagtgtacccttcgaataagcaccggctaactacgtgccagcagccgcggtaatacgtagggtgcaagcgttatccggaattattgggcgtaaagagctcgtaggcggttcgtcgcgtccggtgtgaaagtccatcgcttaacggtggatctgcgccgggtacgggcgggctggagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggatgctggatgtggggcccattccacgggttccgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgacagccccagagatggggcctcccttcggggcgggttcacaggtggtgcatggtcgtcgtcagctcgtgtcgtgagatgttgggttaagtcccgcaacgagcgcaaccctcgccccgtgttgccagcacatgatggtgggaactcacgggggaccgccggggttaactcggaggaaggtggggatgacgtcagatcatcatgccccttacgtccagggcttcacgcatgctacaatggccggtacaacgggatgcgacatggcgacatggagcggatccctgaaaaccggtctcagttcggattggagtctgcaacccgactccatgaaggcggagtcgctagtaatcgcgaatcagcaacgtcgcggtgaatgcgttcccgggccttgtacacaccgcccgtcaagtcatgaaagtgggtagcacccgaagccggtggcccaaccagttcgctggggggagccgtctaaggtgagactcgtgattgggactaagtcgtaacaaggtagccgtaccggaaggtgcggctggatcacctcctttct

SEQ ID NO: 65 - DNA, 1307 bp, Artificial Sequence
  Bifidobacterium_angulatum
gagagtttggacctggctcaggatgaacgctggcggcgtgcttaacacatgcaagtcgaacgggatccgacaagcttgcttgtcggtgagagtggcgaacgggtgagtaatgcgtgaccgacctgccccatacaccggaatagctcctggaaacgggtggtaatgccggatgctccagtccatcgcatggtggtctgggaaagatttcatcggtatgggatggggtcgcgtcctatcaggtagtcggcggggtaacggcccaccgagcctacgacgggtagccggcctgagagggcgaccggccacattgggactgagatacggcccagactcctacgggaggcagcagtggggaatattgcacaatgggcgcaagcctgatgcagcgacgccgcgtgcgggatgacggccttcgggttgtaaaccgcttttgatcgggagcaagccttcgggtgagttacctcgaataagcaccggctaactacgtgccagcagccgcggtaatacgtagggtgcaagcgttatccggaattattgggcgtaaaggggtggtaggcggttcgtcgcgtccggtgtgaaagtccatcgcttaacggtggatccgccccgggtacgggcgggcttgagtgcggtaggggagactggaattcccggtgtaacggtggaatgtgtagatatcgggaagaacaccaatggcgaaggcaggtctctgggccgtccctgacgatgaggagagaaagcgtggggagggaacaagattagataccctggtagttccccccgtaaacggtggatgctggatgtggggcccattccacgggttcagtgtcggagctaacgcgtaagctcgccgcctgggagacgcccgcaaggctaaaactcaaagaaattgacgggggcccgcacaagcggcggagcatgcggattaattcgatgcaacgcgaagaaccttacctgggcttgacatgttcccgacagccccagagatggggcctcccttcggggcgggttcacaggtggtgcatggtcgtcgtcagctcgtgtcgtgagatgttgggttaagtcccgcaacgagcgcaaccctcgccctgtgttgccagcacgtcatggtgggaactcacgggggaccgccggggtcaactcggaggaaggtggggatgacgtcagatcatcatgccccttacgtccagggcttcacgcatgctacaatggccggtacaacgggatgcgacatggcgacatggagcggatcccttaaaaccggtctcagttcggattggagtctgcaacccgactccatgaagtcg

SEQ ID NO: 66 - DNA, 1313 bp, Artificial Sequence
  Bifidobacterium_animalis
gtcggggtgagagtggcgaacgggtgagtaatgcgtgaccaacctgccctgtgcaccggaatagctccaggaaacgggtggtaataccggatgctccgctccatcgcatgggtggggtgggaaatgcttttgcggcatgggatggggtcgcgtcctatcagcttgttggcggggtgatggcccaccaaggcgttgacgggtagccggcctgagagggtgaccggccacattgggactgagatacggcccagactcctacgggaggcagcagtggggaatattgcacaatgggcgcaagcctgatgcagcgacgccgcgtgcgggatggaggccttcgggttgtaaaccgcttttgttcaagggcaaggcacggtttcggccgtgttgagtggattgttcgaataagcaccggctaactacgtgccagcagccgcggtaatacgtagggtgcgagcgttatccggatttattgggcgtaaagggctcgtaggcggttcgtcgcgtccggtgtgaaagtccatcgcctaacggtggatctgcgccgggtacgggcgggctggagtgcggtaggggagactggaattcccggtgtaacggtggaatggcgggctggagtgcggtaggggagactggaattcccggtgtaacggtggaatgtgtagatatcgggaagaacaccaatggcgaaggcaggtctctgggccgtcactgacgctgaggagcgaaagcgtggggagcgaacaggattagataccctggtagtccacgccgtaaacggtggatgctggatgtggggccctttccacgggtcccgtgtcggagccaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgtgccggatcgccgtggagacacggtttcccttcggggccggttcacaggtggtgcatggtcgtcgtcagctcgtgtcgtgagatgttgggttaagtcccgcaacgagcgcaaccctcgccgcatgttgccagcgggtgatgccgggaactcatgtgggaccgccggggtcaactcggaggaaggaggggatgacgtcagatcatcatgccccttacgtccagggcttcacgcatgcttcaatggccggtacaacgcggtgcgacacggtgacgtggggcggatcgctgaaaaccggtctcagttcggatcgcagtctgcaactcgactgcgtgaaggcggagtcgctagtaatc

SEQ ID NO: 67 - DNA, 1394 bp, Artificial Sequence
  Bifidobacterium_animalis
caagtcgaacgggatccctggcagcttgctgtcggggtgagagtggcgaacgggtgagtaatgcgtgaccaacctgccctgtgcaccggaatagctcctggaaacgggtggtaataccggatgctccgctccatcgcatggtggggtgggaaatgcttttgcggcatgggatggggtcgcgtcctatcagcttgttggcggggtgatggcccaccaaggcgttgacgggtagccggcctgagagggtgaccggccacattgggactgagatacggcccagactcctacgggaggcagcagtggggaatattgcacaatgggcgcaagcctgatgcagcgacgccgcgtgcgggatggaggccttcgggttgtaaaccgcttttgttcaagggcaaggcacggtttcggccgtgttgagtggattgttcgaataagcaccggctaactacgtgccagcagccgcggtaatacgtagggtgcgagcgttatccggatttattgggcgtaaagggctcgtaggcggttcgtcgcgtccggtgtgaaagtccatcgcctaacggtggatctgcgccgggtacgggcgggctggagtgcggtaggggagactggaattcccggtgtaacggtggaatgtgtagatatcgggaagaacaccaatggcgaaggcaggtctctgggccgtcactgacgctgaggagcgaaagcgtggggagcgaacaggattagataccctggtagtccacgccgtaaacggtggatgctggatgtggggccctttccacgggtcccgtgtcggagccaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgtgccggatcgccgtggagacacggtttcccttcggggccggttcacaggtggtgcatggtcgtcgtcagctcgtgtcgtgagatgttgggttaagtcccgcaacgagcgcaaccctcgccgcatgttgccagcgggtgatgccgggaactcatgtgggaccgccggggtcaactcggaggaaggtggggatgacgtcagatcatcatgccccttacgtccagggcttcacgcatgctacaatggccggtacaacgcggtgcgacacggtgacgtggggcggatcgctgaaaaccggtctcagttcggatcgcagtctgcaactcgactgcgtgaaggcggagtcgctagtaatcgcggatcagcaacgccgcggtgaatgcgttcccgggccttgtacacaccgcccgtcaagtcatgaaagtgggtagcacccgaagccggtggcccgacccttgtgg

SEQ ID NO: 68 - DNA, 1541 bp, Artificial Sequence
  Bifidobacterium_animalis
tttttgtggagggttcgattctggctcaggatgaacgctggcggcgtgcttaacacatgcaagtcgaacgggatccctggcagcttgctgtcggggtgagagtggcgaacgggtgagtaatgcgtgaccaacctgccctgtgcaccggaatagctcctggaaacgggtggtaataccggatgctccgctccatcgcatggtggggtgggaaatgcttttgcggcatgggatggggtcgcgtcctatcagcttgttggcggggtgatggcccaccaaggcgttgacgggtagccggcctgagagggtgaccggccacattgggactgagatacggcccagactcctacgggaggcagcagtggggaatattgcacaatgggcgcaagcctgatgcagcgacgccgcgtgcgggatggaggccttcgggttgtaaaccgcttttgttcaagggcaaggcacggtttcggccgtgttgagtggattgttcgaataagcaccggctaactacgtgccagcagccgcggtaatacgtagggtgcgagcgttatccggatttattgggcgtaaagggctcgtaggcggttcgtcgcgtccggtgtgaaagtccatcgcctaacggtggatctgcgccgggtacgggcgggctggagtgcggtaggggagactggaattcccggtgtaacggtggaatgtgtagatatcgggaagaacaccaatggcgaaggcaggtctctgggccgtcactgacgctgaggagcgaaagcgtggggagcgaacaggattagataccctggtagtccacgccgtaaacggtggatgctggatgtggggccctttccacgggtcccgtgtcggagccaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgtgccggatcgccgtggagacacggtttcccttcgggccggttcacaggtggtgcatggtcgtcgtcagctcgtgtcgtgagatgttgggttaagtcccgcaacgagcgcaaccctcgccgcatgttgccagcgggtgatgccgggaactcatgtgggaccgccggggtcaactcggaggaaggtggggatgacgtcagatcatcatgccccttacgtccagggcttcacgcatgctacaatggccggtacaacgcggtgcgacacggtgacgtggggcggatcgctgaaaaccggtctcagttcggatcgcagtctgcaactcgactgcgtgaaggcggagtcgctagtaatcgcggatcagcaacgccgcggtgaatgcgttcccgggccttgtacacaccgcccgtcaagtcatgaaagtgggtagcacccgaagccggtggcccgacccttgtggggggagccgtctaaggtgagactcgtgattgggactaagtcgtaacaaggtagccgtaccggaaggtgcggctggatcacctcctttct

SEQ ID NO: 69 - DNA, 1453 bp, Artificial Sequence
  Bifidobacterium_animalis
gaacgctggcggcgtgcttaacacatgcaagtcgaacgggatccctggcagcttgctgtcggggtgagagtggcgaacgggtgagtaatgcgtgaccaacctgccctgtgcaccggaatagctcctggaaacgggtggtaataccggatgctccgctccatcgcatggtggggtgggaaatgcttttgcggcatgggatggggtcgcgtcctatcagcttgttggcggggtgatggcccaccaaggcgttgacgggtagccggcctgagagggtgacccggccacattgggactgagatacggcccagactcctacgggaggcagcagtggggaatattgcacaatgggcgcaagcctgatgcagcgacgccgcgtgcgggatggaggccttcgggttgtaaaccgcttttgttcaagggcaaggcacggtttcggccgtgttgagtggattgttcgaataagcaccggctaactacgtgccagcagccgcggtaatacgtagggtgcgagcgttatccggatttattgggcgtaaagggctcgtaggcggttcgtcgcgtccggtgtgaaagtccatcgcctaacggtggatctgcgccgggtacgggcgggctggagtgcggtaggggagactggaattcccggtgtaacggtggaatgtgtagatatcgggaagaacaccaatggcgaaggcaggtctctgggccgtcactgacgctgaggagcgaaagcgtggggagcgaacaggattagataccctggtagtccacgccgtaaacggtggatgctggatgtggggccctttccacgggtcccgtgtcggagccaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgtgccggatcgccgtggagacacggtttcccttcggggccggttcacaggtggtgcatggtcgtcgtcagctcgtgtcgtgagatgttgggttaagtcccgcaacgagcgcaaccctcgccgcatgttgccagcgggtgatgccgggaactcatgtgggaccgccggggtcaactcggaggaaggtggggatgacgtcagatcatcatgccccttacgtccagggcttcacgcatgctacaatggccggtacaacgcggtgcgacacggtgacgtggggcggatcgctgaaaaccggtctcagttcggatcgcagtctgcaactcgactgcgtgaaggcggagtcgctagtaatcgcggatcagcaacgccgcggtgaatgcgttcccgggccttgtacacaccgcccgtcaagtcatgaaagtgggtagcacccgaagccggtggcccgacccttgtggggggagccgtctaaggtgagactcgtgattg

SEQ ID NO: 70 - DNA, 1526 bp, Artificial Sequence
  Bifidobacterium_animalis
tcgattctggctcaggatgaacgctggcggcgtgcttaacacatgcaagtcgaacgggatccctggcagcttgctgtcggggtgagagtggcgaacgggtgagtaatgcgtgaccaacctgccctgtgcaccggaatagctcctggaaacgggtggtaataccggatgctccgctccatcgcatggtggggtgggaaatgcttttgcggcatgggatggggtcgcgtcctatcagcttgttggcggggtgatggcccaccaaggcgttgacgggtagccggcctgagagggtgaccggccacattgggactgagatacggcccagactcctacgggaggcagcagtggggaatattgcacaatgggcgcaagcctgatgcagcgacgccgcgtgcgggatggaggccttcgggttgtaaaccgcttttgttcaagggcaaggcacggtttcggccgtgttgagtggattgttcgaataagcaccggctaactacgtgccagcagccgcggtaatacgtagggtgcgagcgttatccggatttattgggcgtaaagggctcgtaggcggttcgtcgcgtccggtgtgaaagtccatcgcctaacggtggatctgcgccgggtacgggcgggctggagtgcggtaggggagactggaattcccggtgtaacggtggaatgtgtagatatcgggaagaacaccaatggcgaaggcaggtctctgggccgtcactgacgctgaggagcgaaagcgtggggagcgaacaggattagataccctggtagtccacgccgtaaacggtggatgctggatgtggggccctttccacgggtcccgtgtcggagccaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgtgccggatcgccgtggagacacggtttcccttcggggccggttcacaggtggtgcatggtcgtcgtcagctcgtgtcgtgagatgttgggttaagtcccgcaacgagcgcaaccctcgccgcatgttgccagcgggtgatgccgggaactcatgtgggaccgccggggtcaactcggaggaaggtggggatgacgtcagatcatcatgccccttacgtccagggcttcacgcatgctacaatggccggtacaacgcggtgcgacacggtgacgtggggcggatcgctgaaaaccggtctcagttcggatcgcagtctgcaactcgactgcgtgaaggcggagtcgctagtaatcgcggatcagcaacgccgcggtgaatgcgttcccgggccttgtacacaccgcccgtcaagtcatgaaagtgggtagcacccgaagccggtggcccgacccttgtggggggagccgtctaaggtgagactcgtgattgggactaagtcgtaacaaggtagccgtaccggaaggtgcggctggatcacctccttt

SEQ ID NO: 71 - DNA, 1549 bp, Artificial Sequence
  Bifidobacterium_animalis
tttttgtggagggttcgattctggctcaggatgaacgctggcggcgtgcttaacacatgcaagtcgaacgggatccctggcagcttgctgtcggggtgagagtggcgaacgggtgagtaatgcgtgaccaacctgccctgtgcaccggaatagctcctggaaacgggtggtaataccggatgctccgctccatcgcatggtggggtgggaaatgcttttgcggcatgggatggggtcgcgtcctatcagcttgttggcggggtgatggcccaccaaggcgttgacgggtagccggcctgagagggtgaccggccacattgggactgagatacggcccagactcctacgggaggcagcagtggggaatattgcacaatgggcgcaagcctgatgcagcgacgccgcgtgcgggatggaggccttcgggttgtaaaccgcttttgttcaagggcaaggcacggtttcggccgtgttgagtggattgttcgaataagcaccggctaactacgtgccagcagccgcggtaatacgtagggtgcgagcgttatccggatttattgggcgtaaagggctcgtaggcggttcgtcgcgtccggtgtgaaagtccatcgcctaacggtggatctgcgccgggtacgggcgggctggagtgcggtaggggagactggaattcccggtgtaacggtggaatgtgtagatatcgggaagaacaccaatggcgaaggcaggtctctgggccgtcactgacgctgaggagcgaaagcgtggggagcgaacaggattagataccctggtagtccacgccgtaaacggtggatgctggatgtggggccctttccacgggtcccgtgtcggagccaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgtgccggatcgccgtggagacacggtttcccttcggggccggttcacaggtggtgcatggtcgtcgtcagctcgtgtcgtgagatgttgggttaagtcccgcaacgagcgcaaccctcgccgcatgttgccagcgggtgatgccgggaactcatgtgggaccgccggggtcaactcggaggaaggtggggatgacgtcagatcatcatgccccttacgtccagggcttcacgcatgctacaatggccggtacaacgcggtgcgacacggtgacgtggggcggatcgctgaaaaccggtctcagttcggatcgcagtctgcaactcgactgcgtgaaggcggagtcgctagtaatcgcggatcagcaacgccgcggtgaatgcgttcccgggccttgtacacaccgcccgtcaagtcatgaaagtgggtagcacccgaagccggtggcccgacccttgtggggggagccgtctaaggtgagactcgtgattgggactaagtcgtaacaaggtagccgtaccggaaggtgcggctggatcacctcctttctacggaga

SEQ ID NO: 72 - DNA, 1530 bp, Artificial Sequence
  Bifidobacterium_animalis
agggttcgattctggctcaggatgaacgctggcggcgtgcttaacacatgcaagtcgaacgggatccctggcagcttgctgtcggggtgagagtggcgaacgggtgagtaatgcgtgaccaacctgccctgtgcaccggaatagctcctggaaacgggtggtaataccggatgctccgctccatcgcatggtggggtgggaaatgcttttgcggcatgggatggggtcgcgtcctatcagcttgttggcggggtgatggcccaccaaggcgttgacgggtagccggcctgagagggtgaccggccacattgggactgagatacggcccagactcctacgggaggcagcagtggggaatattgcacaatgggcgcaagcctgatgcagcgacgccgcgtgcgggatggaggccttcgggttgtaaaccgcttttgttcaagggcaaggcacggtttcggccgtgttgagtggattgttcgaataagcaccggctaactacgtgccagcagccgcggtaatacgtagggtgcgagcgttatccggatttattgggcgtaaagggctcgtaggcggttcgtcgcgtccggtgtgaaagtccatcgcctaacggtggatctgcgccgggtacgggcgggctggagtgcggtaggggagactggaattcccggtgtaacggtggaatgtgtagatatcgggaagaacaccaatggcgaaggcaggtctctgggccgtcactgacgctgaggagcgaaagcgtggggagcgaacaggattagataccctggtagtccacgccgtaaacggtggatgctggatgtggggccctttccacgggtcccgtgtcggagccaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgtgccggatcgccgtggagacacggtttcccttcggggccggttcacaggtggtgcatggtcgtcgtcagctcgtgtcgtgagatgttgggttaagtcccgcaacgagcgcaaccctcgccgcatgttgccagcgggtgatgccgggaactcatgtgggaccgccggggtcaactcggaggaaggtggggatgacgtcagatcatcatgccccttacgtccagggcttcacgcatgctacaatggccggtacaacgcggtgcgacacggtgacgtggggcggatcgctgaaaaccggtctcagttcggatcgcagtctgcaactcgactgcgtgaaggcggagtcgctagtaatcgcggatcagcaacgccgcggtgaatgcgttcccgggccttgtacacaccgcccgtcaagtcatgaaagtgggtagcacccgaagccggtggcccgacccttgtggggggagccgtctaaggtgagactcgtgattgggactaagtcgtaacaaggtagccgtaccggaaggtgcggctggatcacctcctt

SEQ ID NO: 73 - DNA, 1550 bp, Artificial Sequence
  Bifidobacterium_animalis
tttttgtggagggttcgattctggctcaggatgaacgctggcggcgtgcttaacacatgcaagtcgaacgggatccctggcagcttgctgtcggggtgagagtggcgaacgggtgagtaatgcgtgaccaacctgccctgtgcaccggaatagctcctggaaacgggtggtaataccggatgctccgctccatcgcatggtggggtgggaaatgcttttgcggcatgggatggggtcgcgtcctatcagcttgttggcggggtgatggcccaccaaggcgttgacgggtagccggcctgagagggtgaccggccacattgggactgagatacggcccagactcctacgggaggcagcagtggggaatattgcacaatgggcgcaagcctgatgcagcgacgccgcgtgcgggatggaggccttcgggttgtaaaccgcttttgttcaagggcaaggcacggtttcggccgtgttgagtggattgttcgaataagcaccggctaactacgtgccagcagccgcggtaatacgtagggtgcgagcgttatccggatttattgggcgtaaagggctcgtaggcggttcgtcgcgtccggtgtgaaagtccatcgcctaacggtggatctgcgcccgggtacgggcgggctggagtgcggtaggggagactggaattcccggtgtaacggtggaatgtgtagatatcgggaagaacaccaatggcgaaggcaggtctctgggccgtcactgacgctgaggagcgaaagcgtggggagcgaacaggattagataccctggtagtccacgccgtaaacggtggatgctggatgtggggccctttccacgggtcccgtgtcggagccaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgtgccggatcgccgtggagacacggtttcccttcggggccggttcacaggtggtgcatggtcgtcgtcagctcgtgtcgtgagatgttgggttaagtcccgcaacgagcgcaaccctcgccgcatgttgccagcgggtgatgccgggaactcatgtgggaccgccggggtcaactcggaggaaggtggggatgacgtcagatcatcatgccccttacgtccagggcttcacgcatgctacaatggccggtacaacgcggtgcgacacggtgacgtggggcggatcgctgaaaaccggtctcagttcggatcgcagtctgcaactcgactgcgtgaaggcggagtcgctagtaatcgcggatcagcaacgccgcggtgaatgcgttcccgggccttgtacacaccgcccgtcaagtcatgaaagtgggtagcacccgaagccggtggcccgacccttgtggggggagccgtctaaggtgagactcgtgattgggactaagtcgtaacaaggtagccgtaccggaaggtgcggctggatcacctcctttctacggaga

SEQ ID NO: 74 - DNA, 1466 bp, Artificial Sequence
  Bifidobacterium_animalis
tctggctcaggatgaacgctggcggcgtgcttaacacatgcaagtcgaacgggatccctggcagcttgctgtcggggtgagagtggcgaacgggtgagtaatgcgtgaccaacctgccctgtgcaccggaatagctcctggaaacgggtggtaataccggatgctccgctccatcgcatggtggggtgggaaatgcttttgcggcatgggatggggtcgcgtcctatcagcttgttggcggggtgatggcccaccaaggcgttgacgggtagccggcctgagagggtgaccggccacattgggactgagatacggcccagactcctacgggaggcagcagtggggaatattgcacaatgggcgcaagcctgatgcagcgacgccgcgtgcgggatggaggccttcgggttgtaaaccgcttttgttcaagggcaaggcacggtttcggccgtgttgagtggattgttcgaataagcaccggctaactacgtgccagcagccgcggtaatacgtagggtgcgagcgttatccggatttattgggcgtaaagggctcgtaggcggttcgtcgcgtccggtgtgaaagtccatcgcctaacggtggatctgcgccgggtacgggcgggctggagtgcggtaggggagactggaattcccggtgtaacggtggaatgtgtagatatcgggaagaacaccaatggcgaaggcaggtctctgggccgtcactgacgctgaggagcgaaagcgtggggagcgaacaggattagataccctggtagtccacgccgtaaacggtggatgctggatgtggggccctttccacgggtcccgtgtcggagccaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgtgccggatcgccgtggagacacggtttcccttcggggccggttcacaggtggtgcatggtcgtcgtcagctcgtgtcgtgagatgttgggttaagtcccgcaacgagcgcaaccctcgccgcatgttgccagcgggtgatgccgggaactcatgtgggaccgccggggtcaactcggaggaaggtggggatgacgtcagatcatcatgccccttacgtccagggcttcacgcatgctacaatggccggtacaacgcggtgcgacacggtgacgtggggcggatcgctgaaaaccggtctcagttcggatcgcagtctgcaactcgactgcgtgaaggcggagtcgctagtaatcgcggatcagcaacgccgcggtgaatgcgttcccgggccttgtacacaccgcccgtcaagtcatgaaagtgggtagcacccgaagccggtggcccgacccttgtggggggagccgtctaaggtgagactcgtgattgg

SEQ ID NO: 75 - DNA, 1542 bp, Artificial Sequence
  Bifidobacterium_animalis
tttttgtggagggttcgattctggctcaggatgaacgctggcggcgtgcttaacacatgcaagtcgaacgggatccctggcagcttgctgtcggggtgagagtggcgaacgggtgagtaatgcgtgaccaacctgccctgtgcaccggaatagctcctggaaacgggtggtaataccggatgctccgctccatcgcatggtggggtgggaaatgcttttgcggcatgggatggggtcgcgtcctatcagcttgttggcggggtgatggcccaccaaggcgttgacgggtagccggcctgagagggtgaccggccacattgggactgagatacggcccagactcctacgggaggcagcagtggggaatattgcacaatgggcgcaagcctgatgcagcgacgccgcgtgcgggatggaggccttcgggttgtaaaccgcttttgttcaagggcaaggcacggtttcggccgtgttgagtggattgttcgaataagcaccggctaactacgtgccagcagccgcggtaatacgtagggtgcgagcgttatccggatttattgggcgtaaagggctcgtaggcggttcgtcgcgtccggtgtgaaagtccatcgcctaacggtggatctgcgccgggtacgggcgggctggagtgcggtaggggagactggaattcccggtgtaacggtggaatgtgtagatatcgggaagaacaccaatggcgaaggcaggtctctgggccgtcactgacgctgaggagcgaaagcgtggggagcgaacaggattagataccctggtagtccacgccgtaaacggtggatgctggatgtggggccctttccacgggtcccgtgtcggagccaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgtgccggatcgccgtggagacacggtttcccttcggggccggttcacaggtggtgcatggtcgtcgtcagctcgtgtcgtgagatgttgggttaagtcccgcaacgagcgcaaccctcgccgcatgttgccagcgggtgatgccgggaactcatgtgggaccgccggggtcaactcggaggaaggtggggatgacgtcagatcatcatgccccttacgtccagggcttcacgcatgctacaatggccggtacaacgcggtgcgacacggtgacgtggggcggatcgctgaaaaccggtctcagttcggatcgcagtctgcaactcgactgcgtgaaggcggagtcgctagtaatcgcggatcagcaacgccgcggtgaatgcgttcccgggccttgtacacaccgcccgtcaagtcatgaaagtgggtagcacccgaagccggtggcccgacccttgtggggggagccgtctaaggtgagactcgtgattgggactaagtcgtaacaaggtagccgtaccggaaggtgcggctggatcacctcctttct

SEQ ID NO: 76 - DNA, 1528 bp, Artificial Sequence
  Bifidobacterium_animalis
agtttgatcatggctcaggatgaacgctggcggcgtgcttaacacatgcaagtcgaacgggatccctggcagcttgctgtcggggtgagagtggcgaacgggtgagtaatgcgtgaccaacctgccctgtgcaccggaatagctcctggaaacgggtggtaataccggatgctccgctccatcgcatggtggggtgggaaatgcttttgcggcatgggatggggtcgcgtcctatcagcttgttggcggggtgatggcccaccaaggcgttgacgggtagccggcctgagagggtgaccggccacattgggactgagatacggcccagactcctacgggaggcagcagtggggaatattgcacaatgggcgcaagcctgatgcagcgacgccgcgtgcgggatggaggccttcgggttgtaaaccgcttttgttcaagggcaaggcacggtttcggccgtgttgagtggattgttcgaataagcaccggctaactacgtgccagcagccgcggtaatacgtagggtgcgagcgttatccggatttattgggcgtaaagggctcgtaggcggttcgtcgcgtccggtgtgaaagtccatcgcctaacggtggatctgcgccgggtacgggcgggctggagtgcggtaggggagactggaattcccggtgtaacggtggaatgtgtagatatcgggaagaacaccaatggcgaaggcaggtctctgggccgtcactgacgctgaggagcgaaagcgtggggagcgaacaggattagataccctggtagtccacgccgtaaacggtggatgctggatgtggggccctttccacgggtcccgtgtcggagccaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgtgccggatcgccgtggagacacggtttcccttcggggccggttcacaggtggtgcatggtcgtcgtcagctcgtgtcgtgagatgttgggttaagtcccgcaacgagcgcaaccctcgccgcatgttgccagcgggtgatgccgggaactcatgtgggaccgccggggtcaactcggaggaaggtggggatgacgtcagatcatcatgccccttacgtccagggcttcacgcatgctacaatggccggtacaacgcggtgcgacacggtgacgtggggcggatcgctgaaaaccggtctcagttcggatcgcagtctgcaactcgactgcgtgaaggcggagtcgctagtaatcgcggatcagcaacgccgcggtgaatgcgttcccgggccttgtacacaccgcccgtcaagtcatgaaagtgggtagcacccgaagccggtggcccgacccttgtggggggagccgtctaaggtgagactcgtgattgggactaagtcgtaacaaggtagccgtaccggaaggtgcggctggatcacctcctt

SEQ ID NO: 77 - DNA, 1412 bp, Artificial Sequence
  Bifidobacterium_bifidum
cagtcgaacgggatccatcgggctttgcttggtggtgagagtggcgaacgggtgagtaatgcgtgaccgacctgccccatgctccggaatagctcctggaaacgggtggtaatgccggatgttccacatgatcgcatgtgattgtgggaaagattctatcggcgtgggatggggtcgcgtcctatcagcttgttggtgaggtaacggctcaccaaggcttcgacgggtagccggcctgagagggcgaccggccacattgggactgagatacggcccagactcctacgggaggcagcagtggggaatattgcacaatgggcgcaagcctgatgcagcgacgccgcgtgagggatggaggccttcgggttgtaaacctcttttgtttgggagcaagccttcgggtgagtgtacctttcgaataagcgccggctaactacgtgccagcagccgcggtaatacgtagggcgcaagcgttatccggatttattgggcgtaaagggctcgtaggcggctcgtcgcgtccggtgtgaaagtccatcgcttaacggtggatctgcgccgggtacgggcgggctggagtgcggtaggggagactggaattcccggtgtaacggtggaatgtgtagatatcgggaagaacaccgatggcgaaggcaggtctctgggccgtcactgacgctgaggagcgaaagcgtggggagcgaacaggattagataccctggtagtccacgccgtaaacggtggacgctggatgtggggcacgttccacgtgttccgtgtcggagctaacgcgttaagcgtcccgcctggggagtacggccgcaaggctaaaactcaaagaaattgacgggggcccgcacaagcggcggagcatgcggattaattcgatgcaacgcgaagaaccttacctgggcttgacatgttcccgacgacgccagagatggcgtttcccttcggggcgggttcacaggtggtgcatggtccgtcgtcagctcgtgtcgtgagatgttgggttaagtcccgcaacgagcgcaaccctcgccccgtgttgccagcacgttatggtgggaactcacgggggaccgccggggttaactcggaggaaggtggggatgacgtcagatcatcatgccccttacgtccagggcttcacgcatgctacaatggccggtacagcgggatgcgacatggcgacatggagcggatccctgaaaaccggtctcagttcggatcggagcctgcaacccggctccgtgaaggcggagtcgctagtaatcgcggatcagcaacgccgcggtgaatgcgttcccgggccttgtacacaccgcccgtcaagtcatgaaagtgggcagcacccgaagccggtggcctaaccccttgtgggatggagccgtctaaggtgaggctcgtg

SEQ ID NO: 78 - DNA, 1488 bp, Artificial Sequence
  Bifidobacterium_bifidum
gatgaacgctggcggcgtgcttaacacatgcaagtcgaacgggatccatcaagcttgcttggtggtgagagtggcgaacgggtgagtaatgcgtgaccgacctgccccatgctccggaatagctcctggaaacgggtggtaatgccggatgttccacatgatcgcatgtgattgtgggaaagattctatcggcgtgggatggggtcgcgtcctatcagcttgttggtgaggtaacggctcaccaaggcttcgacgggtagccggcctgagagggcgaccggccacattgggactgagatacggcccagactcctacgggaggcagcagtggggaatattgcacaatgggcgcaagcctgatgcagcgacgccgcgtgagggatggaggccttcgggttgtaaacctcttttgtttgggagcaagccttcgggtgagtgtacctttcgaataagcgccggctaactacgtgccagcagccgcggtaatacgtagggcgcaagcgttatccggatttattgggcgtaaagggctcgtaggcggctcgtcgcgtccggtgtgaaagtccatcgcttaacggtggatctgcgccgggtacgggcgggctggagtgcggtaggggagactggaattcccggtgtaacggtggaatgtgtagatatcgggaagaacaccgatggcgaaggcaggtctctgggccgtcactgacgctgaggagcgaaagcgtggggagcgaacaggattagataccctggtagtccacgccgtaaacggtggacgctggatgtggggcacgttccacgtgttccgtgtcggagctaacgcgttaagcgtcccgcctggggagtacggccgcaaggctaaaactcaaagaaattgacgggggcccgcacaagcggcggagcatgcggattaattcgatgcaacgcgaagaaccttacctgggcttgacatgttcccgacgacgccagagatggcgtttcccttcggggcgggttcacaggtggtgcatggtcgtcgtcagctcgtgtcgtgagatgttgggttaagtcccgcaacgagcgcaaccctcgccccgtgttgccagcacgttatggtgggaactcacgggggaccgccggggttaactcggaggaaggtggggatgacgtcagatcatcatgccccttacgtccagggcttcacgcatgctacaatggccggtacagcgggatgcgacatggcgacatggagcggatccctgaaaaccggtctcagttcggatcggagcctgcaacccggctccgtgaaggcggagtcgctagtaatcgcggatcagcaacgccgcggtgaatgcgttcccgggccttgtacacaccgcccgtcaagtcatgaaagtgggcagcacccgaagccggtggcctaaccccttgtgggatggagccgtctaaggtgaggctcgtgattgggactaagtcgtaacaaggtagccgtaccggaaggtgcggctg

SEQ ID NO: 79 - DNA, 1538 bp, Artificial Sequence
  Bifidobacterium_bifidum
tttttgtggagggttcgattctggctcaggatgaacgctggcggcgtgcttaacacatgcaagtcgaacgggatccatcaagcttgcttggtggtgagagtggcgaacgggtgagtaatgcgtgaccgacctgccccatgctccggaatagctcctggaaacgggtggtaatgccggatgttccacatgatcgcatgtgattgtgggaaagattctatcggcgtgggatggggtcgcgtcctatcagcttgttggtgaggtaacggctcaccaaggcttcgacgggtagccggcctgagagggcgaccggccacattgggactgagatacggcccagactcctacgggaggcagcagtggggaatattgcacaatgggcgcaagcctgatgcagcgacgccgcgtgagggatggaggccttcgggttgtaaacctcttttgtttgggagcaagccttcgggtgagtgtacctttcgaataagcgccggctaactacgtgccagcagccgcggtaatacgtagggcgcaagcgttatccggatttattgggcgtaaagggctcgtaggcggctcgtcgcgtccggtgtgaaagtccatcgcttaacggtggatctgcgccgggtacgggcgggctggagtgcggtaggggagactggaattcccggtgtaacggtggaatgtgtagatatcgggaagaacaccgatggcgaaggcaggtctctgggccgtcactgacgctgaggagcgaaagcgtggggagcgaacaggattagataccctggtagtccacgccgtaaacggtggacgctggatgtggggcacgttccacgtgttccgtgtcggagctaacgcgttaagcgtcccgcctggggagtacggccgcaaggctaaaactcaaagaaattgacgggggcccgcacaagcggcggagcatgcggattaattcgatgcaacgcgaagaaccttacctgggcttgacatgttcccgacgacgccagagatggcgtttcccttcggggcgggttcacaggtggtgcatggtcgtcgtcagctcgtgtcgtgagatgttgggttaagtcccgcaacgagcgcaaccctcgccccgtgttgccagcacgttatggtgggaactcacgggggaccgccggggttaactcggaggaaggtggggatgacgtcagatcatcatgccccttacgtccagggcttcacgcatgctacaatggccggtacagcgggatgcgacatggcgacatggagcggatccctgaaaaccggtctcagttcggatcggagcctgcaacccggctccgtgaaggcggagtcgctagtaatcgcggatcagcaacgccgcggtgaatgcgttcccgggccttgtacacaccgcccgtcaagtcatgaaagtgggcagcacccgaagccggtggcctaaccccttgtgggatggagccgtctaaggtgaggctcgtgattgggactaagtcgtaacaaggtagccgtaccggaaggtgcggctggatcacctcctttctacggag

SEQ ID NO: 80 - DNA, 1532 bp, Artificial Sequence
  Bifidobacterium_bifidum
tttttgtggagggttcgattctggctcaggatgaacgctggcggcgtgcttaacacatgcaagtcgaacgggatccatcaagcttgcttggtggtgagagtggcgaacgggtgagtaatgcgtgaccgacctgccccatgctccggaatagctcctggaaacgggtggtaatgccggatgttccacatgatcgcatgtgattgtgggaaagattctatcggcgtgggatggggtcgcgtcctatcagcttgttggtgaggtaacggctcaccaaggcttcgacgggtagccggcctgagagggcgaccggccacattgggactgagatacggcccagactcctacgggaggcagcagtggggaatattgcacaatgggcgcaagcctgatgcagcgacgccgcgtgagggatggaggccttcgggttgtaaacctcttttgtttgggagcaagccttcgggtgagtgtacctttcgaataagcgccggctaactacgtgccagcagccgcggtaatacgtagggcgcaagcgttatccggatttattgggcgtaaagggctcgtaggcggctcgtcgcgtccggtgtgaaagtccatcgcttaacggtggatctgcgccgggtacgggcgggctggagtgcggtaggggagactggaattcccggtgtaacggtggaatgtgtagatatcgggaagaacaccgatggcgaaggcaggtctctgggccgtcactgacgctgaggagcgaaagcgtggggagcgaacaggattagataccctggtagtccacgccgtaaacggtggacgctggatgtggggcacgttccacgtgttccgtgtcggagctaacgcgttaagcgtcccgcctggggagtacggccgcaaggctaaaactcaaagaaattgacgggggcccgcacaagcggcggagcatgcggattaattcgatgcaacgcgaagaaccttacctgggcttgacatgttcccgacgacgtcagagatggcgtttcccttcggggcgggttcacaggtggtgcatggtcgtcgtcagctcgtgtcgtgagatgttgggttaagtcccgcaacgagcgcaaccctcgccccgtgttgccagcacgttatggtgggaactcacgggggaccgccggggttaactcggaggaaggtggggatgacgtcagatcatcatgccccttacgtccagggcttcacgcatgctacaatggccggtacagcgggatgcgacatggcgacatggagcggatccctgaaaaccggtctcagttcggatcggagcctgcaacccggctccgtgaaggcggagtcgctagtaatcgcggatcagcaacgccgcggtgaatgcgttcccgggccttgtacacaccgcccgtcaagtcatgaaagtgggcagcacccgaagccggtggcctaaccccttgtgggatggagccgtctaaggtgaggctcgtgattgggactaagtcgtaacaaggtagccgtaccggaaggtgcggctggatcacctcctttct

SEQ ID NO: 81 - DNA, 1364 bp, Artificial Sequence
  Bifidobacterium_bifidum
gatccatcgggctttgcttggtggtgagagtggcgaacgggtgagtaatgcgtgaccgacctgccccatgctccggaatagctcctggaaacgggtggtaatgccggatgttccacatgatcgcatgtgattgtgggaaagattctatcggcgtgggatggggtcgcgtcctatcagcttgttggtgaggtaacggctcaccaaggcttcgacgggtagccggcctgagagggcgaccggccacattgggactgagatacggcccagactcctacgggaggcagcagtggggaatattgcacaatgggcgcaagcctgatgcagcgacgccgcgtgagggatggaggccttcgggttgtaaacctcttttgtttgggagcaagccttcgggtgagtgtacctttcgaataagcgccggctaactacgtgccagcagccgcggtaatacgtagggcgcaagcgttatccggatttattgggcgtaaagggctcgtaggcggctcgtcgcgtccggtgtgaaagtccatcgcttaacggtggatctgcgccgggtacgggcgggctggagtgcggtaggggagactggaattcccggtgtaacggtggaatgtgtagatatcgggaagaacaccgatggcgaaggcaggtctctgggccgtcactgacgctgaggagcgaaagcgtggggagcgaacaggattagataccctggtagtccacgccgtaaacggtggacgctggatgtggggcacgttccacgtgttccgtgtcggagctaacgcgttaagcgtcccgcctggggagtacggccgcaaggctaaaactcaaagaaattgacgggggcccgcacaagcggcggagcatgcggattaattcgatgcaacgcgaagaaccttacctgggcttgacatgttcccgacgacgccagagatggcgtttcccttcggggcgggttcacaggtggtgcatggtcgtcgtcagctcgtgtcgtgagatgttgggttaagtcccgcaacgagcgcaaccctcgccccgtgttgccagcacgttatggtgggaactcacgggggaccgccggggttaactcggaggaaggtggggatgacgtcagatcatcatgccccttacgtccagggcttcacgcatgctacaatggccggtacagcgggatgcgacatggcgacatggagcggatccctgaaaaccggtctcagttcggatcggagcctgcaacccggctccgtgaaggcggagtcgctagtaatcgcggatcagcaacgccgcggtgaatgcgttcccgggccttgtacacaccgcccgtcaagtcatgaaagtgggcagcacccgaagccggtggcctaacc

SEQ ID NO: 82 - DNA, 1533 bp, Artificial Sequence
  Bifidobacterium_bifidum
tttttgtggagggttcgattctggctcaggatgaacgctggcggcgtgcttaacacatgcaagtcgaacgggatccatcgggctttgcttggtggtgagagtggcgaacgggtgagtaatgcgtgaccgacctgccccatgctccggaatagctcctggaaacgggtggtaatgccggatgttccacatgatcgcatgtgattgtgggaaagattctatcggcgtgggatggggtcgcgtcctatcagcttgttggtgaggtaacggctcaccaaggcttcgacgggtagccggcctgagagggcgaccggccacattgggactgagatacggcccagactcctacgggaggcagcagtggggaatattgcacaatgggcgcaagcctgatgcagcgacgccgcgtgagggatggaggccttcgggttgtaaacctcttttgtttgggagcaagccttcgggtgagtgtacctttcgaataagcgccggctaactacgtgccagcagccgcggtaatacgtagggcgcaagcgttatccggatttattgggcgtaaagggctcgtaggcggctcgtcgcgtccggtgtgaaagtccatcgcttaacggtggatctgcgccgggtacgggcgggctggagtgcggtaggggagactggaattcccggtgtaacggtggaatgtgtagatatcgggaagaacaccgatggcgaaggcaggtctctgggccgtcactgacgctgaggagcgaaagcgtggggagcgaacaggattagataccctggtagtccacgccgtaaacggtggacgctggatgtggggcacgttccacgtgttccgtgtcggagctaacgcgttaagcgtcccgcctggggagtacggccgcaaggctaaaactcaaagaaattgacgggggcccgcacaagcggcggagcatgcggattaattcgatgcaacgcgaagaaccttacctgggcttgacatgttcccgacgacgccagagatggcgtttcccttcggggcgggttcacaggtggtgcatggtcgtcgtcagctcgtgtcgtgagatgttgggttaagtcccgcaacgagcgcaaccctcgccccgtgttgccagcacgttatggtgggaactcacgggggaccgccggggttaactcggaggaaggtggggatgacgtcagatcatcatgccccttacgtccagggcttcacgcatgctacaatggccggtacagcgggatgcgacatggcgacatggagcggatccctgaaaaccggtctcagttcggatcggagcctgcaacccggctccgtgaaggcggagtcgctagtaatcgcggatcagcaacgccgcggtgaatgcgttcccgggccttgtacacaccgcccgtcaagtcatgaaagtgggcagcacccgaagccggtggcctaaccccttgtgggatggagccgtctaaggtgaggctcgtgattgggactaagtcgtaacaaggtagccgtaccggaaggtgcggctggatcacctcctttct

SEQ ID NO: 83 - DNA, 1535 bp, Artificial Sequence
  Bifidobacterium_breve
tttttgtggagggttcgattctggctcaggatgaacgctggcggcgtgcttaacacatgcaagtcgaacgggatccatcgggctttgcctggtggtgagagtggcgaacgggtgagtaatgcgtgaccgacctgccccatgcaccggaatagctcctggaaacgggtggtaatgccggatgctccatcacaccgcatggtgtgttgggaaagcctttgcggcatgggatggggtcgcgtcctatcagcttgatggcggggtaacggcccaccatggcttcgacgggtagccggcctgagagggcgaccggccacattgggactgagatacggcccagactcctacgggaggcagcagtggggaatattgcacaatgggcgcaagcctgatgcagcgacgccgcgtgagggatggaggccttcgggttgtaaacctcttttgttagggagcaaggcactttgtgttgagtgtacctttcgaataagcaccggctaactacgtgccagcagccgcggtaatacgtagggtgcaagcgttatccggaattattgggcgtaaagggctcgtaggcggttcgtcgcgtccggtgtgaaagtccatcgcttaacggtggatccgcgccgggtacgggcgggcttgagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggatgctggatgtggggcccgttccacgggttccgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgacgatcccagagatggggtttcccttcggggcgggttcacaggtggtgcatggtcgtcgtcagctcgtgtcgtgagatgttgggttaagtcccgcaacgagcgcaaccctcgccccgtgttgccagcggattgtgccgggaactcacgggggaccgccggggttaactcggaggaaggtggggatgacgtcagatcatcatgccccttacgtccagggcttcacgcatgctacaatggccggtacaacgggatgcgacagtgcgagctggagcggatccctgaaaaccggtctcagttcggatcgcagtctgcaactcgactgcgtgaaggcggagtcgctagtaatcgcgaatcagcaacgtcgcggtgaatgcgttcccgggccttgtacacaccgcccgtcaagtcatgaaagtgggcagcacccgaagccggtggcctaaccccttgcgggagggagccgtctaaggtgaggctcgtgattgggactaagtcgtaacaaggtagccgtaccggaaggtgcggctggatcacctcctttct

SEQ ID NO: 84 - DNA, 1535 bp, Artificial Sequence
  Bifidobacterium_breve
tttttgtggagggttcgattctggctcaggatgaacgctggcggcgtgcttaacacatgcaagtcgaacgggatccatcgggctttgcctggtggtgagagtggcgaacgggtgagtaatgcgtgaccgacctgccccatgcaccggaatagctcctggaaacgggtggtaatgccggatgctccatcacaccgcatggtgtgttgggaaagcctttgcggcatgggatggggtcgcgtcctatcagcttgatggcggggtaacggcccaccatggcttcgacgggtagccggcctgagagggcgaccggccacattgggactgagatacggcccagactcctacgggaggcagcagtggggaatattgcacaatgggcgcaagcctgatgcagcgacgccgcgtgagggatggaggccttcgggttgtaaacctcttttgttagggagcaaggcacttcgtgttgagtgtacctttcgaataagcaccggctaactacgtgccagcagccgcggtaatacgtagggtgcaagcgttatccggaattattgggcgtaaagggctcgtaggcggttcgtcgcgtccggtgtgaaagtccatcgcttaacggtggatccgcgccgggtacgggcgggcttgagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggatgctggatgtggggcccgttccacgggttccgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgacgatcccagagatggggtttcccttcggggcgggttcacaggtggtgcatggtcgtcgtcagctcgtgtcgtgagatgttgggttaagtcccgcaacgagcgcaaccctcgccccgtgttgccagcggattgtgccgggaactcacgggggaccgccggggttaactcggaggaaggtggggatgacgtcagatcatcatgccccttacgtccagggcttcacgcatgctacaatggccggtacaacgggatgcgacagcgcgagctggagcggatccctgaaaaccggtctcagttcggatcgcagtctgcaactcgactgcgtgaaggcggagtcgctagtaatcgcgaatcagcaacgtcgcggtgaatgcgttcccgggccttgtacacaccgcccgtcaagtcatgaaagtgggcagcacccgaagccggtggcctaaccccttgcgggagggagccgtctaaggtgaggctcgtgattgggactaagtcgtaacaaggtagccgtaccggaaggtgcggctggatcacctcctttct

SEQ ID NO: 85 - DNA, 1535 bp, Artificial Sequence
  Bifidobacterium_breve
tttttgtggagggttcgattctggctcaggatgaacgctggcggcgtgcttaacacatgcaagtcgaacgggatccatcgggctttgcttggtggtgagagtggcgaacgggtgagtaatgcgtgaccgacctgccccatgcaccggaatagctcctggaaacgggtggtaatgccggatgctccatcacaccgcatggtgtgttgggaaagcctttgcggcatgggatggggtcgcgtcctatcagcttgatggcggggtaacggcccaccatggcttcgacgggtagccggcctgagagggcgaccggccacattgggactgagatacggcccagactcctacgggaggcagcagtggggaatattgcacaatgggcgcaagcctgatgcagcgacgccgcgtgagggatggaggccttcgggttgtaaacctcttttgttagggagcaaggcactttgtgttgagtgtacctttcgaataagcaccggctaactacgtgccagcagccgcggtaatacgtagggtgcaagcgttatccggaattattgggcgtaaagggctcgtaggcggttcgtcgcgtccggtgtgaaagtccatcgcttaacggtggatccgcgccgggtacgggcgggcttgagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggatgctggatgtggggcccgttccacgggttccgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgacgatcccagagatggggtttcccttcggggcgggttcacaggtggtgcatggtcgtcgtcagctcgtgtcgtgagatgttgggttaagtcccgcaacgagcgcaaccctcgccccgtgttgccagcggattgtgccgggaactcacgggggaccgccggggttaactcggaggaaggtggggatgacgtcagatcatcatgccccttacgtccagggcttcacgcatgctacaatggccggtacaacgggatgcgacagtgcgagctggagcggatccctgaaaaccggtctcagttcggatcgcagtctgcaactcgactgcgtgaaggcggagtcgctagtaatcgcgaatcagcaacgtcgcggtgaatgcgttcccgggccttgtacacaccgcccgtcaagtcatgaaagtgggcagcacccgaagccggtggcctaaccccttgcgggagggagccgtctaaggtgaggctcgtgattgggactaagtcgtaacaaggtagccgtaccggaaggtgcggctggatcacctcctttct

SEQ ID NO: 86 - DNA, 1406 bp, Artificial Sequence
  Bifidobacterium_breve
gatgaacgctggcggcgtgcttaacacatgcaagtcgaacgggatccatcgggctttgcctggtggtgagagtggcgaacgggtgagtaatgcgtgaccgacctgccccatgcaccggaatagctcctggaaacgggtggtaatgccggatgctccatcacaccgcatggtgtgttgggaaagcctttgcggcatgggatggggtcgcgtcctatcagcttgatggcggggtaacggcccaccatggcttcgacgggtagccggcctgagagggcgaccggccacattgggactgagatacggcccagactcctacgggaggcagcagtggggaatattgcacaatgggcgcaagcctgatgcagcgacgccgcgtgagggatggaggccttcgggttgtaaacctcttttgttagggagcaaggcactttgtgttgagtgtacctttcgaataagcaccggctaactacgtgccagcagccgcggtaatacgtagggtgcaagcgttatccggaattattgggcgtaaagggctcgtaggcggttcgtcgcgtccggtgtgaaagtccatcgcttaacggtggatccgcgccgggtacgggcgggcttgagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggatgctggatgtggggcccgttccacgggttccgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgacgatcccagagatggggtttcccttcggggcgggttcacaggtggtgcatggtcgtcgtcagctcgtgtcgtgagatgttgggttaagtcccgcaacgagcgcaaccctcgccccgtgttgccagcggattgtgccgggaactcacgggggaccgccggggttaactcggaggaaggtggggatgacgtcagatcatcatgccccttacgtccagggcttcacgcatgctacaatggccggtacaacgggatgcgacagtgcgagctggagcggatccctgaaaaccggtctcagttcggatcgcagtctgcaactcgactgcgtgaaggcggagtcgctagtaatcgcgaatcagcaacgtcgcggtgaatgcgttcccgggccttgtacacaccgcccgtcaagtcatgaaagtgggcagcacccgaagccggtggcctaa

SEQ ID NO: 87 - DNA, 1535 bp, Artificial Sequence
  Bifidobacterium_breve
tttttgtggagggttcgattctggctcaggatgaacgctggcggcgtgcttaacacatgcaagtcgaacgggatccatcgggctttgcctggtggtgagagtggcgaacgggtgagtaatgcgtgaccgacctgccccatgcaccggaatagctcctggaaacgggtggtaatgccggatgctccatcacaccgcatggtgtgttgggaaagcctttgcggcatgggatggggtcgcgtcctatcagcttgatggcggggtaacggcccaccatggcttcgacgggtagccggcctgagagggcgaccggccacattgggactgagatacggcccagactcctacgggaggcagcagtggggaatattgcacaatgggcgcaagcctgatgcagcgacgccgcgtgagggatggaggccttcgggttgtaaacctcttttgttagggagcaaggcactttgtgttgagtgtacctttcgaataagcaccggctaactacgtgccagcagccgcggtaatacgtagggtgcaagcgttatccggaattattgggcgtaaagggctcgtaggcggttcgtcgcgtccggtgtgaaagtccatcgcttaacggtggatccgcgccgggtacgggcgggcttgagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggatgctggatgtggggcccgttccacgggttccgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgacgatcccagagatggggtttcccttcggggcgggttcacaggtggtgcatggtcgtcgtcagctcgtgtcgtgagatgttgggttaagtcccgcaacgagcgcaaccctcgccccgtgttgccagcggattatgccgggaactcacgggggaccgccggggttaactcggaggaaggtggggatgacgtcagatcatcatgccccttacgtccagggcttcacgcatgctacaatggccggtacaacgggatgcgacagcgcgagctggagcggatccctgaaaaccggtctcagttcggatcgcagtctgcaactcgactgcgtgaaggcggagtcgctagtaatcgcgaatcagcaacgtcgcggtgaatgcgttcccgggccttgtacacaccgcccgtcaagtcatgaaagtgggcagcacccgaagccggtggcctaaccccttgcgggagggagccgtctaaggtgaggctcgtgattgggactaagtcgtaacaaggtagccgtaccggaaggtgcggctggatcacctcctttct

SEQ ID NO: 88 - DNA, 1532 bp, Artificial Sequence
  Bifidobacterium_catenulatum
tttttgtggagggttcgattctggctcaggatgaacgctggcggcgtgcttaacacatgcaagtcgaacgggatccaggcagcttgctgcctggtgagagtggcgaacgggtgagtaatgcgtgaccgacctgccccatacaccggaatagctcctggaaacgggtggtaatgccggatgctccgactcctcgcatggggtgtcgggaaagatttcatcggtatgggatggggtcgcgtcctatcaggtagtcggcggggtaacggcccaccgagcctacgacgggtagccggcctgagagggcgaccggccacattgggactgagatacggcccagactcctacgggaggcagcagtggggaatattgcacaatgggcgcaagcctgatgcagcgacgccgcgtgcgggatgacggccttcgggttgtaaaccgcttttgatcgggagcaagccttcgggtgagtgtacctttcgaataagcaccggctaactacgtgccagcagccgcggtaatacgtagggtgcaagcgttatccggaattattgggcgtaaagggctcgtaggcggttcgtcgcgtccggtgtgaaagtccatcgcttaacggtggatctgcgccgggtacgggcgggctggagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggatgctggatgtggggcccgttccacgggttccgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgacagccgtagagatacggtctcccttcggggcgggttcacaggtggtgcatggtcgtcgtcagctcgtgtcgtgagatgttgggttaagtcccgcaacgagcgcaaccctcgccctgtgttgccagcacgtcatggtgggaactcacgggggaccgccggggtcaactcggaggaaggtggggatgacgtcagatcatcatgccccttacgtccagggcttcacgcatgctacaatggccggtacaacgggatgcgacatggcgacatggagcggatccctgaaaaccggtctcagttcggattggagtctgcaacccgactccatgaaggcggagtcgctagtaatcgcggatcagcaacgccgcggtgaatgcgttcccgggccttgtacacaccgcccgtcaagtcatgaaagtgggtagcacccgaagccggtggcctaaccccttgtgggatggagccgtctaaggtgagactcgtgattgggactaagtcgtaacaaggtagccgtaccggaaggtgcggctggatcacctcctttct

SEQ ID NO: 89 - DNA, 1480 bp, Artificial Sequence
  Bifidobacterium_catenulatum
gatgaacgctggcggcgtgcttaacacatgcaagtcgaacgggatccaggcagcttgctgcctggtgagagtggcgaacgggtgagtaatgcgtgaccgacctgccccatacaccggaatagctcctggaaacgggtggtaatgccggatgctccgactcctcgcatggggtgtcgggaaagatttcatcggtatgggatggggtcgcgtcctatcaggtagtcggcggggtaacggcccaccgagcctacgacgggtagccggcctgagagggcgaccggccacattgggactgagatacggcccagactcctacgggaggcagcagtggggaatattgcacaatgggcgcaagcctgatgcagcgacgccgcgtgcgggatgacggccttcgggttgtaaaccgcttttgatcgggagcaagccttcgggtgagtgtacctttcgaataagcaccggctaactacgtgccagcagccgcggtaatacgtagggtgcaagcgttatccggaattattgggcgtaaagggctcgtaggcggttcgtcgcgtccggtgtgaaagtccatcgcttaacggtggatctgcgccggctacgggcgggctggagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggatgctggatgtggggcccgttccacgggttccgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgacagccgtagagatacggtctcccttcggggcgggttcacaggtggtgcatggtcgtcgtcagctcgtgtcgtgagatgttgggttaagtcccgcaacgagcgcaaccctcgccctgtgttgccagcacgtcatggtgggaactcacgggggaccgccggggtcaactcggaggaaggtggggatgacgtcagatcatcatgccccttacgtccagggcttcacgcatgctacaatggccggtacaacgggatgcgacatggcgacatggagcggatccctgaaaaccggtctcagttcggattggagtctgcaacccgactccatgaaggcggagtcgctagtaatcgcggatcagcaacgccgcggtgaatgcgttcccgggccttgtacacaccgcccgtcaagtcatgaaagtgggtagcacccgaagccggtggcctaaccccttgtgggatggagccgtctaaggtgagactcgtgattgggactaagtcgtaacaaggcagccgtaccggaagg

SEQ ID NO: 90 - DNA, 1535 bp, Artificial Sequence
  Bifidobacterium_dentium
ttttcgtggagggttcgattctggctcaggatgaacgctggcggcgtgcttaacacatgcaagtcgaacgggatcccgggggttcgcctccgggtgagagtggcgaacgggtgagtaatgcgtgaccgacctgccccatacaccggaatagctcctggaaacgggtggtaatgccggatgctccggttggatgcatgtccttccgggaaaggttccatcggtatgggatggggtcgcgtcctatcagcttgatggcggggtaacggcccaccatggcttcgacgggtagccggcctgagagggcgaccggccacattgggactgagatacggcccagactcctacgggaggcagcagtggggaatattgcacaatgggcgcaagcctgatgcagcgacgccgcgtgcgggatggaggccttcgggttgtaaaccgcttttgatcgggagcaagcccttcggggtgagtgtacccttcgaataagcaccggctaactacgtgccagcagccgcggtaatacgtagggtgcaagcgttatccggaattattgggcgtaaagggctcgtaggcggttcgtcgcgtccggtgtgaaagcccatcgcttaacggtgggtctgcgccgggtacgggcgggctggagtgcggtaggggagactggaattcccggtgtaacggtggaatgtgtagatatcgggaagaacaccaatggcgaaggcaggtctctgggccgtcactgacgctgaggagcgaaagcgtggggagcgaacaggattagataccctggtagtccacgccgtaaacggtggatgctggatgtggggcccgttccacgggttccgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgacggccgtagagatacggcctcccttcggggcgggttcacaggtggtgcatggtcgtcgtcagctcgtgtcgtgagatgttgggttaagtcccgcaacgagcgcaaccctcgccctgtgttgccagcacgtcatggtgggaactcacgggggaccgccggggtcaactcggaggaaggtggggatgacgtcagatcatcatgccccttacgtccagggcttcacgcatgctacaatggccggtacagcgggatgcgacatggcgacatggagcggatccctgaaaaccggtctcagttcggattggagtctgcaacccgactccatgaaggcggagtcgctagtaatcgcggatcagcaacgccgcggtgaatgcgttcccgggccttgtacacaccgcccgtcaagtcatgaaagtgggcagcacccgaagccggtggcctaacccttctgtgggatggagccgtctaaggtgaggctcgtgattgggactaagtcgtaacaaggtagccgtaccggaaggtgcggctggatcacctcctttct

SEQ ID NO: 91 - DNA, 1539 bp, Artificial Sequence
  Bifidobacterium_dentium
ttttcgtggagggttcgattctggctcaggatgaacgctggcggcgtgcttaacacatgcaagtcgaacgggatcccgggggttcgcctccgggtgagagtggcgaacgggtgagtaatgcgtgaccgacctgccccatacaccggaatagctcctggaaacgggtggtaatgccggatgctccggttggatgcatgtccttccgggaaaggttccatcggtatgggatggggtcgcgtcctatcagcttgatggcggggtaacggcccaccatggcttcgacgggtagccggcctgagagggcgaccggccacattgggactgagatacggcccagactcctacgggaggcagcagtggggaatattgcacaatgggcgcaagcctgatgcagcgacgccgcgtgcgggatggaggccttcgggttgtaaaccgcttttgatcgggagcaagcccttcggggtgagtgtacccttcgaataagcaccggctaactacgtgccagcagccgcggtaatacgtagggtgcaagcgttatccggaattattgggcgtaaagggctcgtaggcggttcgtcgcgtccggtgtgaaagcccatcgcttaacggtgggtctgcgccgggtacgggcgggctggagtgcggtaggggagactggaattcccggtgtaacggtggaatgtgtagatatcgggaagaacaccaatggcgaaggcaggtctctgggccgtcactgacgctgaggagcgaaagcgtggggagcgaacaggattagataccctggtagtccacgccgtaaacggtggatgctggatgtggggcccgttccacgggttccgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgacggccgtagagatacggcctcccttcggggcgggttcacaggtggtgcatggtcgtcgtcagctcgtgtcgtgagatgttgggttaagtcccgcaacgagcgcaaccctcgccctgtgttgccagcacgtcatggtgggaactcacgggggaccgccggggtcaactcggaggaaggtggggatgacgtcagatcatcatgccccttacgtccagggcttcacgcatgctacaatggccggtacagcgggatgcgacatggcgacatggagcggatccctgaaaaccggtctcagttcggattggagtctgcaacccgactccatgaaggcggagtcgctagtaatcgcggatcagcaacgccgcggtgaatgcgttcccgggccttgtacacaccgcccgtcaagtcatgaaagtgggcagcacccgaagccggtggcctaacccttctgtgggatggagccgtctaaggtgaggctcgtgattgggactaagtcgtaacaaggtagccgtaccggaaggtgcggctggatcacctcctttctacgg

SEQ ID NO: 92 - DNA, 1534 bp, Artificial Sequence
  Bifidobacterium_dentium
tttttatggagggttcgattctggctcaggatgaacgctggcggcgtgcttaacacatgcaagtcgaacgggatcccgggggttcgctcccgggtgagagtggcgaacgggtgagtaatgcgtgaccgacctgccccatacaccggaatagctcctggaaacgggtggtaatgccggatgctccggttggatgcatgtccttccgggaaagattccatcggtatgggatggggtcgcgtcctatcagcttgatggcggggtaacggcccaccatggcttcgacgggtagccggcctgagagggcgaccggccacattgggactgagatacggcccagactcctacgggaggcagcagtggggaatattgcacaatgggcgcaagcctgatgcagcgacgccgcgtgcgggatggaggccttcgggttgtaaaccgcttttgatcgggagcaagcccttcggggtgagtgtacctttcgaataagcaccggctaactacgtgccagcagccgcggtaatacgtagggtgcaagcgttatccggaattattgggcgtaaagggctcgtaggcggttcgtcgcgtccggtgtgaaagcccatcgcttaacggtgggtctgcgccgggtacgggcgggctggagtgcggtaggggagactggaattcccggtgtaacggtggaatgtgtagatatcgggaagaacaccaatggcgaaggcaggtctctgggccgtcactgacgctgaggagcgaaagcgtggggagcgaacaggattagataccctggtagtccacgccgtaaacggtggatgctggatgtggggcccgttccacgggttccgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgacagccgtagagatatggcctcccttcggggcgggttcacaggtggtgcatggtcgtcgtcagctcgtgtcgtgagatgttgggttaagtcccgcaacgagcgcaaccctcgccctgtgttgccagcacgtcatggtgggaactcacgggggaccgccggggtcaactcggaggaaggtggggatgacgtcagatcatcatgccccttacgtccagggcttcacgcatgctacaatggccggtacagcgggatgcgacatggcgacatggagcggatccctgaaaaccggtctcagttcggattggagtctgcaacccgactccatgaaggcggagtcgctagtaatcgcggatcagcaacgccgcggtgaatgcgttcccgggccttgtacacaccgcccgtcaagtcatgaaagtgggcagcacccgaagccggtggcctaaccccttgcgggatggagccgtctaaggtgaggctcgtgattgggactaagtcgtaacaaggtagccgtaccggaaggtgcggctggatcacctcctttct

SEQ ID NO: 93 - DNA, 1477 bp, Artificial Sequence
  Bifidobacterium_dentium
  misc_feature (94)..(94): n is a, c, g, or t
  misc_feature (136)..(136): n is a, c, g, or t
  misc_feature (176)..(176): n is a, c, g, or t
  misc_feature (206)..(206): n is a, c, g, or t
  misc_feature (231)..(232): n is a, c, g, or t
  misc_feature (236)..(236): n is a, c, g, or t
  misc_feature (255)..(255): n is a, c, g, or t
  misc_feature (259)..(259): n is a, c, g, or t
  misc_feature (267)..(268): n is a, c, g, or t
  misc_feature (286)..(287): n is a, c, g, or t
  misc_feature (334)..(335): n is a, c, g, or t
  misc_feature (387)..(387): n is a, c, g, or t
  misc_feature (400)..(403): n is a, c, g, or t
  misc_feature (409)..(409): n is a, c, g, or t
  misc_feature (436)..(436): n is a, c, g, or t
  misc_feature (510)..(510): n is a, c, g, or t
  misc_feature (529)..(529): n is a, c, g, or t
  misc_feature (570)..(572): n is a, c, g, or t
  misc_feature (579)..(580): n is a, c, g, or t
  misc_feature (612)..(613): n is a, c, g, or t
  misc_feature (715)..(715): n is a, c, g, or t
  misc_feature (728)..(728): n is a, c, g, or t
  misc_feature (730)..(731): n is a, c, g, or t
  misc_feature (821)..(821): n is a, c, g, or t
  misc_feature (829)..(829): n is a, c, g, or t
  misc_feature (863)..(863): n is a, c, g, or t
  misc_feature (911)..(912): n is a, c, g, or t
  misc_feature (915)..(915): n is a, c, g, or t
  misc_feature (927)..(927): n is a, c, g, or t
  misc_feature (949)..(950): n is a, c, g, or t
  misc_feature (974)..(974): n is a, c, g, or t
  misc_feature (986)..(986): n is a, c, g, or t
  misc_feature (1006)..(1008): n is a, c, g, or t
  misc_feature (1022)..(1022): n is a, c, g, or t
  misc_feature (1033)..(1033): n is a, c, g, or t
  misc_feature (1277)..(1277): n is a, c, g, or t
  misc_feature (1356)..(1356): n is a, c, g, or t
  misc_feature (1368)..(1368): n is a, c, g, or t
  misc_feature (1372)..(1372): n is a, c, g, or t
  misc_feature (1386)..(1386): n is a, c, g, or t
  misc_feature (1394)..(1394): n is a, c, g, or t
  misc_feature (1407)..(1407): n is a, c, g, or t
  misc_feature (1434)..(1434): n is a, c, g, or t
tttcgtggagggttcgattctggctcaggatgaacgctggcggcgtgcttaacacatgcaagtcgaacgggatcccgggggttcgcctccgggngagagtggcgaacgggtgagtaatgcgtgaccgacctgcccnatacaccggaatagctcctggaaacgggtggtaatgccgnatgctccggttggatgcatgtccttccggnaaaggttccatcggtatgggatggnntcgngtcctatcagcttgatggngggntaacggcnnaccatggcttcgacgggnngccggcctgagagggcgaccggccacattgggactgagatacggccnngactcctacgggaggcagcagtggggaatattgcacaatgggcgcaagcctnatgcagcgacgcnnnntgcggnatggaggccttcgggttgtaaaccgcntttgatcgggagcaagcccttcggggtgagtgtacccttcgaataagcaccggctaactacgtgccagcagccncggtaatacgtagggtgcnagcgttatccggaattattgggcgtaaagggctcgtaggcnnntcgtcgnntccggtgtgaaagcccatcgcttaacggtggnnctgcgccgggtacgggcgggctggagtgcggtaggggagactggaattcccggtgtaacggtggaatgtgtagatatcgggaagaacaccaatggcgaaggnaggtctctgggcngnnactgacgctgaggagcgaaagcgtggggagcgaacaggattagataccctggtagtccacgccgtaaacggtggatgctggatgtggggngttccacnggttccgtgtcggagctaacgcgttaagcatccngcctggggagtacggccgcaaggctaaaactcaaagaaattgacgggnnccngcacaagcggcngagcatgcggattaattcgatnnaacgcgaagaaccttacctgggcntgacatgttccngacggccgtagagatacggnnnccttcgggacgggntcacaggtggngcatggtcgtcgtcagctcgtgtcgtgagatgttgggttaagtcccgcaacgagcgcaaccctcgccctgtgttgccagcacgtcacggtgggaactcacgggggaccgccggggtcaactcggaggaaggtggggatgacgtcagatcatcatgccccttacgtccagggcttcacgcatgctacaatggccggtacagcgggatgcgacatggcgacatggagcggatccctgaaaaccggnctcagttcggattggagtctgcaacccgactccatgaaggcggagtcgctagtaatcgcggatcagcaacgccgcggtnaatgcgttcccnggcnttgtacacaccgcncgtcaagncatgaaagtgggnagcacccgaagccggtggcctaacccntctgtgggatggagccgtctaaggtgaggctcgtgattgggac

SEQ ID NO: 94 - DNA, 1551 bp, Artificial Sequence
  Bifidobacterium_gallicum
tttttgtggagggttcgattctggctcaggatgaacgctggcggcgtgcttaacacatgcaagtcgaacgggatccggccgagcttgtcttggctggtgagagtggcgaacgggtgagtaatgcgtgaccaacctgccttgtgcaccggaatagctcctggaaacgggtggtaataccggatgttccgctccatcgcatggtggtgtgggaaatgcttttgcggcatgggatggggtcgcgtcctatcagcttgttggcggggtgacggcccaccaaggctttgacgggtagccggcctgagagggtgaccggccacattgggactgagatacggcccagactcctacgggaggcagcagtggggaatattgcacaatgggcgcaagcctgatgcagcgacgccgcgtgcgggatggaggccttcgggttgtaaaccgcttttgattgtcagcaaggcgtcctttcggggatgttgagtgtagctttcgaataagcaccggctaactacgtgccagcagccgcggtaatacgtagggtgcaagcgttatccggaattattgggcgtaaagggctcgtaggcggttcgtcgcgtccggtgtgaaagtccatcgcttaacggtggatctgcgccgggtacgggcgggctggagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggatgctggatgtggggccctttttccgggtcctgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttccggatcgccccagagatggggtttcccttcggggccggttcacaggtggtgcatggtcgtcgtcagctcgtgtcgtgagatgttgggttaagtcccgcaacgagcgcaaccctcgccgcgtgttgccagcgggtcatgccgggaactcacgtgggaccgccggggtcaactcggaggaaggtggggatgacgtcagatcatcatgccccttacgtccagggcttcacgcatgctacaatggccggtacaacgggatgcgacaccgtgaggtggggcggatccctgaaaaccggtctcagttcggatcgcagtctgcaacccgactgcgtgaaggcggagtcgctagtaatcgcagatcagcaacgctgcggtgaatgcgttcccgggccttgtacacaccgcccgtcaagtcatgaaagtgggtagcacccgaagccggtggcccgaccgccttgtgtggggggagccgtctaaggtgagactcgtgattgggactaagtcgtaacaaggtagccgtaccggaaggtgcggctggatcacctcctttctacgg

SEQ ID NO: 95 - DNA, 1400 bp, Artificial Sequence
  Bifidobacterium_infantis
gattctggctcaggatgaacgctggcggcgtgcttaacacatgcaagtcgaacgggatccatcaggctttgcttggtggtgagagtggcgaacgggtgagtaatgcgtgaccgacctgccccatacaccggaatagctcctggaaacgggtggtaatgccggatgctccagttgatcgcatggtcttctgggaaagctttcgcggtatgggatggggtcgcgtcctatcagcttgacggcggggtaacggcccaccgtggcttcgacgggtagccggcctgagagggcgaccggccacattgggactgagatacggcccagactcctacgggaggcagcagtggggaatattgcacaatgggcgcaagcctgatgcagcgacgccgcgtgagggatggaggccttcgggttgtaaacctcttttatcggggagcaagcgagagtgagtttacccgttgaataagcaccggctaactacgtgccagcagccgcggtaatacgtagggtgcaagcgttatccggaattattgggcgtaaagggctcgtaggcggttcgtcgcgtccggtgtgaaagtccatcgcttaacggtggatccgcgccgggtacgggcgggcttgagtgcggtaggggagactggaattcccggtgtaacggtggaatgtgtagatatcgggaagaacaccaatggcgaaggcaggtctctgggccgttactgacgctgaggagcgaaagccgtggggagcgaacaggattagataccctggtagtccacgccgtaaacggtggatgctggatgtggggcccgttccacgggttccgtgtcggagctaacgcgttaagcatcccgcctggggagtacggccgcaagctaaaaactcaaagaaattgacgggggcccgcacaagcggcggagcatgcggattaattcgatcgaacgcgaagaaccttacctgggcttgacatgttcccgacggtcgtagagatacggcttcccttcggggcgggttcacaggtggtgcatggtcgtcgtcacgtcgtgtcgtgagatgttgggttaagtcccgcaacgagcgcaaccctcgccccgtgttgccagcggattatgccgggaactcacgggggaccgccggggttaactcggaggaaggtggggatgacgtcagatcatcatgccccttacgtccagggcttcacgcatgctacaatggccggtacaacgggatgcgacgcggcgacgcggagcggatccctgaaaaccggtctcagttcggatcgcagtctgcaactcgactgcgtgaaggcggagtcgctagtaatcgcgaatcagcaacgtcgcggtgaatgcgttcccgggccttgtacacaccgcccgtcaagtcatgaaagtgggtagcacccg

SEQ ID NO: 96 - DNA, 1515 bp, Artificial Sequence
  Bifidobacterium_kashiwanohense
agggttcgattctggctcaggatgaacgctggcggcgtgcttaacacatgcaagtcgaacgggatcccaggagcttgctcctgggtgttagtggcgaacgggtgagtaatgcgtgaccgacctgccccatgcaccggaatagctcctggaaacgggtggtaatgccggatgctccatcacactgcatggtgtgttgggaaagcctttgcggcatgggatggggtcgcgtcctatcagcttgatggcggggtaacggcccaccatggcttcgacgggtagccggcctgagagggcgaccggccacattgggactgagatacggcccagactcctacgggaggcagcagtggggaatattgcacaatgggcgcaagcctgatgcagcgacgccgcgtgcgggatgacggccttcgggttgtaaaccgcttttgatcgggagcaagccttcgggtgagtgtacctttcgaataagcaccggctaactacgtgccagcagccgcggtaatacgtagggtgcaagcgttatccggaattattgggcgtaaagggctcgtaggcggttcgtcgcgtccggtgtgaaagtccatcgcttaacggtggatctgcgccgggtacgggcgggctggagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggatgctggatgtggggcccgttccacgggttccgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgaccgttccagagatggggcttcccttcggggcgggttcacaggtggtgcatggtcgtcgtcagctcgtgtcgtgagatgttgggttaagtcccgcaacgagcgcaaccctcgccctgtgttgccagcacgtcatggtgggaactcacgggggaccgccggggtcaactcggaggaaggtggggatgacgtcagatcatcatgccccttacgtccagggcttcacgcatgctacaatggccggtacaacgggatgcgacacggcgacgtggagcggatccctgaaaaccggtctcagttcggattggagtctgcaacccgactccatgaaggcggagtcgctagtaatcgcggatcagcaacgccgcggtgaatgcgttcccgggccttgtacacaccgcccgtcaagtcatgaaagtgggtagcacccgaagccggtggcctaacccttcgtgggatggagccgtctaaggtgagactcgtgattgggactaagtcgtaacaaggtaaccgtaccggaaggtgcggctggatcacct

SEQ ID NO: 97 - DNA, 1348 bp, Artificial Sequence
  Bifidobacterium_longum
gtggcgaacgggtgagtaatgcgtgaccgacctgccccatacaccggaatagctcctggaaacgggtggtaatgccggatgctccagttgatcgcatggtcttctgggaaagctttcgcggtatgggatggggtcgcgtcctatcagcttgacggcggggtcaacggctccaccgtggcttcsacgggtagccsgaccatgagagggcgaccgsccacattgggactgaratacggcccagactcctacgggaggcagcagtggggaatattgcacaatgggcgcaagcctgatgcarcgacsccgcgtgagggatggaggccttcsggttgtaaacctcttttatcggggagcaagcgagagtgagtttacccgttgaataagcaccgsctaactacgtgccagcagccgcggtaatacgtagggtgcaagcgttatccggaattattgggcgtaaagggctcgtaggcggttcgtcgcgtccggtgtgaaagtccatcgcttaacggtggatccgcgccgggtacrggcgggctttgagtgcggtaggggagactggaattyccsgtgtaacggtggaatgtgtagatatcgggaagaacaccaatgggcgaaggcaggtctctgggccgttactgacgctgaggagcgaaagcgtggggagcgaacaggattagataccctggtagtccacgccgtaaacgggtggatgctggatgtggggcccgttwcacgggttyccgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgacggtcgtagagatacggcttcccttcggggcgggttcacaggtggtgcatggtcgtcgtcagctcgtgtcgtgagatgttgggttaagtcccgcaacgagcgcaaccctcgccccgtgttgccagcggattatgccgggaactcacgggggaccgccggggttaactcggaggaaggtggggatgacgtcagatcatcatgccccttacgtccagggcttcacgcatgctacaatggccggtacaacgggatgcgacgcggtgacgcggagcggatccctgaaaaccggtctcagttcggatcgcagtctgcaactcgactgcgtgaaggcggagtcgctagtaatcgcgaatcagcaacgtcgcggtgaatgcgttcccgggccttgtacacaccgcccgtcaagtcatgaaagtgggcagcacccgaagccggtggcctaaccccttgtgg

SEQ ID NO: 98 - DNA, 1331 bp, Artificial Sequence
  Bifidobacterium_longum
gatgaacgctggcggcgtgcttaacacatgcaagtcgaacgagtggcgaacgggtgagtaatgcgtgaccgacctgccccatacaccggaatagctcctggaaacgggtggtaatgccggatgctgaaaggcggtatgggatggggtcgcgtcctatcagcttgacggcggggtaacggcccaccgtggcttcgacgggtagccggcctgagagggcgaccggccacattgggactgagatacggcccagactcctacgggaggcagcagtggggaatattgcacaatgggcgcaagcctgatgcagcgacgccgcgtgagggatggaggccttcgggttgtaaacctcttttatcggggagcatgagtttacccgttgaataagcaccggctaactacgtgccagcagccgcggtaatacgtagggtgcaagcgttatccggaattattgggcgtaaagggctcgtaggcggttcgtcgcgtccggtgtgaaagtccatcgcttaacggtggatccgcgccgggtacgggcgggcttgagtgcggtaggggagactggaattcccggtgtaacggtggaatgtgtagatatcgggaagaacaccaatggcgaaggcaggtctctgggccgactgacgctgaggagcgaaagcgtggggagcgaacaggattagataccctggtagtccacgccgtaaacggtggatgctggatgtggggcgttccgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgcacaggtggtgcatggtcgtcgtcagctcgtgtcgtgagatgttgggttaagtcccgcaacgagcgcaaccctcgccccgtgttgccagcggccgggaactcacgggggaccgccggggttaactcggaggaaggtggggatgacgtcagatcatcatgccccttacgtccagggcttcacgcatgctacaatggccggcaacgggatgcgacgcggcgacgcggagcggatccctgccggtctcagttcggacgcagtctgcaactcgactgcggaaggcggagtcgctagtaatcgcgaatcagcaacgtcgcggtgaatgcgttcccgggccttgtacacaccgcccgtcaagtcatgaaagtgggcagcacccgaagccggtgcctatggagccgtctaaggtgaggctcgtgattgggactaagtcgtaacaaggtagccgtaccggaaggtgc

SEQ ID NO: 99 - DNA, 1228 bp, Artificial Sequence
  Bifidobacterium_longum
cgaacgagtggcgaacgggtgagtaatgcgtgaccgacctgccccatacaccggaatagctcctggaaacgggtggtaatgccggatgctgaaaggcggtatgggatggggtcgcgtcctatcagcttgacggcggggtaacggcccaccgtggcttcgacgggtagccggcctgagagggcgaccggccacattgggactgagatacggcccagactcctacgggaggcagcagtggggaatattgcacaatgggcgcaagcctgatgcagcgacgccgcgtgagggatggaggccttcgggttgtaaacctcttttatcggggagcatgagtttacccgttgaataagcaccggctaactacgtgccagcagccgcggtaatacgtagggtgcaagcgttatccggaattattgggcgtaaagggctcgtaggcggttcgtcgcgtccggtgtgaaagtccatcgcttaacggtggatccgcgccgggtacgggcgggcttgagtgcggtaggggagactggaattcccggtgtaacggtggaatgtgtagatatcgggaagaacaccaatggcgaaggcaggtctctgggccgactgacgctgaggagcgaaagcgtggggagcgaacaggattagataccctggtagtccacgccgtaaacggtggatgctggatgtggggcgttccgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgcacaggtggtgcatggtcgtcgtcagctcgtgtcgtgagatgttgggttaagtcccgcaacgagcgcaaccctcgccccgtgttgccagcggccgggaactcacgggggaccgccggggttaactcggaggaaggtggggatgacgtcagatcatcatgccccttacgtccagggcttcacgcatgctacaatggccggcaacgggatgcgacgcggcgacgcggagcggatccctgccggtctcagttcggacgcagtctgcaactcgactgcggaaggcggagtcgctagtaatcgcgaatcagcaacgtcgcggtgaatgcgttcccgggccttgtacacaccgcccgtcaagtcatgaaagtgggcagcacccgaagccggtgccta

SEQ ID NO: 100 - DNA, 1526 bp, Artificial Sequence
  Bifidobacterium_longum
tgtggagggttcgattctggctcaggatgaacgctggcggcgtgcttaacacatgcaagtcgaacgggatccatcaggctttgcttggtggtgagagtggcgaacgggtgagtaatgcgtgaccgacctgccccatacaccggaatagctcctggaaacgggtggtaatgccggatgctccagttgatcgcatggtcttctgggaaagctttcgcggtatgggatggggtcgcgtcctatcagcttgacggcggggtaacggcccaccgtggcttcgacgggtagccggcctgagagggcgaccggccacattgggactgagatacggcccagactcctacgggaggcagcagtggggaatattgcacaatgggcgcaagcctgatgcagcgacgccgcgtgagggatggaggccttcgggttgtaaacctcttttatcggggagcaagcgagagtgagtttacccgttgaataagcaccggctaactacgtgccagcagccgcggtaatacgtagggtgcaagcgttatccggaattattgggcgtaaagggctcgtaggcggttcgtcgcgtccggtgtgaaagtccatcgcttaacggtggatccgcgccgggtacgggcgggcttgagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggatgctggatgtggggcccgttccacgggttccgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgacggtcgtagagatgcggcttcccttcggggcgggttcacaggtggtgcatggtcgtcgtcagctcgtgtcgtgagatgttgggttaagtcccgcaacgagcgcaaccctcgccccgtgttgccagcggattatgccgggaactcacgggggaccgccggggttaactcggaggaaggtggggatgacgtcagatcatcatgccccttacgtccagggcttcacgcatgctacaatggccggtacaacgggatgcgacgcggcgacgcggagcggatccctgaaaaccggtctcagttcggatcgcagtctgcaactcgactgcgtgaaggcggagtcgctagtaatcgcgaatcagcaacgtcgcggtgaatgcgttcccgggccttgtacacaccgcccgtcaagtcatgaaagtgggcagcacccgaagccggtggcctaaccccttgtgggatggagccgtctaaggtgaggctcgtgattgggactaagtcgtaacaaggtagccgtaccggaaggtgcggctggatcacctcctttct

SEQ ID NO: 101 - DNA, 1242 bp, Artificial Sequence
  Bifidobacterium_longum
atgggattgggtttcctttctatcagatgacgggggggtaacccccccacggttgcttcggggggtagccggcgtgagagggccgaccgcctcattgtgagtgagatacggccctgattcgtacgggagccagcagtagtgattatcgcacaatgcaagcaagcctgatgcagggacgccgcgtgaggaatggaggccttcggtttgtaaacctcgtttatgggggagcaagcgagagtgagtttacccgttgaataagcaccggctaactacgtgccagcagccgcggtaatacgtagggtgcaagcgttatccggaattattgggcgtaaagggctcgtaggcggttcgtcgcgtccggtgtgaaagtccatcgcttaacggtggatccgcgccgggtacgggcgggcttgagtgcggtaggggagactggaattcccggtgtaacggtggaatgtgtagatatcgggaagaacaccaatggcgaaggcaggtctctgggccgtcactgacgctgaggagcgaaagcgtggggagcgaacaggattagataccctggtagtccacgccgtaaacggtggatgctggatgtggggcccgttccacgggttccgtgtcgtagcctaacgcgttaagcatcctgcctggggagtacggccgcaaggctaatactcaaagaaatagatgggggcgcgcacaagaggcggagcatgcggattaattagatgcaacgcgaagaacctcacctgggcttgacatgttctcgacggtagtagagatacggcttcccttcggggcgggttcacaggtggtgcatggtcgtcgtcagctcgtgtcgtgagatgttgggttaagtcccgcaacgagcgcaaccctcgccccgtgttgccagcggattatgccgggaactcacgggggaccgccggggttaactcggaggaaggtggggaggacgtcagatcatcatgcccctcacgtccagggcttcacgcatgctacaatggccggtacaacgggatgcgacgcggtgacgcggagcggatcccccaaaaccggtctcagttcggatcgcagtatgcaactcgactgcgcgaaggcggagtcgctagtaatcgcgaatcagcaacgtcgcggtgaatgcgttcccgggccttgtacacaccgcccgccaagtcagaaagaggcagcacccgaagccggtgcctaacccctgtggagggagccgtctaaggtaggctcggt

SEQ ID NO: 102 - DNA, 1529 bp, Artificial Sequence
  Bifidobacterium_longum
tttttgtggagggttcgattctggctcaggatgaacgctggcggcgtgcttaacacatgcaagtcgaacgggatccatcaagcttgcttggtggtgagagtggcgaacgggtgagtaatgcgtgaccgacctgccccatacaccggaatagctcctggaaacgggtggtaatgccggatgttccagttgatcgcatggtcttctgggaaagctttcgcggtatgggatggggtcgcgtcctatcagcttgacggcggggtaacggcccaccgtggcttcgacgggtagccggcctgagagggcgaccggccacattgggactgagatacggcccagactcctacgggaggcagcagtggggaatattgcacaatgggcgcaagcctgatgcagcgacgccgcgtgagggatggaggccttcgggttgtaaacctcttttatcggggagcaagcgtgagtgagtttacccgttgaataagcaccggctaactacgtgccagcagccgcggtaatacgtagggtgcaagcgttatccggaattattgggcgtaaagggctcgtaggcggttcgtcgcgtccggtgtgaaagtccatcgcttaacggtggatccgcgccgggtacgggcgggcttgagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggatgctggatgtggggcccgttccacgggttccgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgacgatcccagagatggggtttcccttcggggcgggttcacaggtggtgcatggtcgtcgtcagctcgtgtcgtgagatgttgggttaagtcccgcaacgagcgcaaccctcgccccgtgttgccagcggattgtgccgggaactcacgggggaccgccggggttaactcggaggaaggtggggatgacgtcagatcatcatgccccttacgtccagggcttcacgcatgctacaatggccggtacaacgggatgcgacgcggcgacgcggagcggatccctgaaaaccggtctcagttcggatcgcagtctgcaactcgactgcgtgaaggcggagtcgctagtaatcgcgaatcagcaacgtcgcggtgaatgcgttcccgggccttgtacacaccgcccgtcaagtcatgaaagtgggcagcacccgaagccggtggcctaaccccttgtgggatggagccgtctaaggtgaggctcgtgattgggactaagtcgtaacaaggtagccgtaccggaaggtgcggctggatcacctcctttct

SEQ ID NO: 103 - DNA, 1330 bp, Artificial Sequence
  Bifidobacterium_longum
agtcgacgggatccatcaagcttgcttggtggtgagagtggcgaacgggtgagtaatgcgtgaccgacctgccccatacaccggaatagctcctggaaacgggtggtaatgccggatgctccagttgatcgcatggtcttctgggaaagctttcgcggtatgggatggggtcgcgtcctatcagcttgacggcggggtaacggcccaccgtggcttcgacgggtagccggcctgagagggcgaccggccacattgggactgagatacggcccagactcctacgggaggcagcagtggggaatattgcacaatgggcgcaagcctgatgcagcgacgccgcgtgagggatggaggccttcgggttgtaaacctcttttatcggggagcaagcgagagtgagtttacccgttgaataagcaccggctaactacgtgccagcagccgcggtaatacgtagggtgcaagcgttatccggaattattgggcgtaaagggctcgtaggcggttcgtcgcgtccggtgtgaaagtccatcgcttaacggtggatccgcgccgggtacgggcgggcttgagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggatgctggatgtggggcccgttccacgggttccgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgacggtcgtagagatacggcttcccttcggggcgggttcacaggtggtgcatggtcgtcgtcagctcgtgtcgtgagatgttgggttaagtcccgcaacgagcgcaaccctcgccccgtgttgccagcggattatgccgggaactcacgggggaccgccggggttaactcggaggaaggtggggatgacgtcagatcatcatgccccttacgtccagggcttcacgcatgctacaatggccggtacaacgggatgcgacgcggcgacgcggagcggatccctgaaaaccggtctcagttcggatcgcagtctgcaactcgactgcgtgaaggcggagtcgctagtaatcgcgaatcagcaacgtcgcggtgaatgcgttcccgggccttgtacacaccgcccgtcaag

SEQ ID NO: 104 - DNA, 1518 bp, Artificial Sequence
  Bifidobacterium_longum
agagtttgatcctggctcaggatgaacgctggcggcgtgcttaacacatgcaagtcgaacgggatccatcaggctttgcttggtggcgagagtggcgaacgggtgagtaatgcgtgaccgacctgccccatacaccggaatagctcctggaaacgggtggtaatgccggatgctccagttgatcgcatggtcttctgggaaagctttcgcggtatgggatggggccgcgtcctatcagcttgacggcggggtaacggcccaccgtggcttcgacgggtagccggcctgagagggcgaccggccacattgggactgagatacggcccagactcctacgggaggcagcagtggggaatattgcacaatgggcgcaagcctgatgcagcgacgccgcgtgagggatggaggccttcgggttgtaaacctcttttatcggggagcaagcgagagtgagtttacccgttgaataagcaccggctaactacgtgccagcagccgcggtaatacgtagggtgcaagcgttatccggaattattgggcgtaaagggctcgtaggcggttcgtcgcgtccggtgtgaaagtccatcgcttaacggtggatccgcgccgggtacgggcgggcttgagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggatgctggatgtggggcccgttccacgggttccgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttctcgacggtcgtagagatgcggcttcccttcggggcgggttcacaggtggtgcatggtcgtcgtcagctcgtgtcgtgagatgttgggttaagtcccgcaacgagcgcaaccctcgccccgtgttgccagcggattatgccgggaactcacgggggaccgccggggttaactcggaggaaggtggggatgacgtcagatcatcatgccccttacgtccagggcttcacgcatgctacaatggccggtacaacgggatgcgacgcggcgacgcggagcggatccctgaaaaccggtctcagttcggatcgcagtctgcaactcgactgcgtgaaggcggagtcgctagtaatcgcgaatcagcaacgtcgcggtgaatgcgttcccgggccttgtacacaccgcccgtcaagtcatgaaagtgggcagcacccgaagccggtggcctaaccccttgtgggatggagccgtctaaggtgaggctcgtgattgggactaagtcgtaacaaggtagccgtaccggaaggtgcggctggatcacctcctt

SEQ ID NO: 105 - DNA, 1530 bp, Artificial Sequence
  Bifidobacterium_longum
tttttgtggagggttcgattctggctcaggatgaacgctggcggcgtgcttaacacatgcaagtcgaacgggatccatcaggctttgcttggtggtgagagtggcgaacgggtgagtaatgcgtgaccgacctgccccatacaccggaatagctcctggaaacgggtggtaatgccggatgctccagttgatcgcatggtcttctgggaaagctttcgcggtatgggatggggtcgcgtcctatcagcttgacggcggggtaacggcccaccgtggcttcgacgggtagccggcctgagagggcgaccggccacattgggactgagatacggcccagactcctacgggaggcagcagtggggaatattgcacaatgggcgcaagcctgatgcagcgacgccgcgtgagggatggaggccttcgggttgtaaacctcttttatcggggagcaagcgagagtgagtttacccgttgaataagcaccggctaactacgtgccagcagccgcggtaatacgtagggtgcaagcgttatccggaattattgggcgtaaagggctcgtaggcggttcgtcgcgtccggtgtgaaagtccatcgcttaacggtggatccgcgccgggtacgggcgggcttgagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggatgctggatgtggggcccgttccacgggttccgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgacggccgtagagatacggcttcccttcggggcgggttcacaggtggtgcatggtcgtcgtcagctcgtgtcgtgagatgttgggttaagtcccgcaacgagcgcaaccctcgccccgtgttgccagcggattatgccgggaactcacgggggaccgccggggttaactcggaggaaggtggggatgacgtcagatcatcatgccccttacgtccagggcttcacgcatgctacaatggccggtacaacgggatgcgacgcggcgacgcggagcggatccctgaaaaccggtctcagttcggatcgcagtctgcaactcgactgcgtgaaggcggagtcgctagtaatcgcgaatcagcaacgtcgcggtgaatgcgttcccgggccttgtacacaccgcccgtcaagtcatgaaagtgggcagcacccgaagccggtggcctaaccccttgtgggatggagccgtctaaggtgaggctcgtgattgggactaagtcgtaacaaggtagccgtaccggaaggtgcggctggatcacctcctttct

SEQ ID NO: 106 - DNA, 1530 bp, Artificial Sequence
  Bifidobacterium_longum
tttttgtggagggttcgattctggctcaggatgaacgctggcggcgtgcttaacacatgcaagtcgaacgggatccatcgggctttgcttggtggtgagagtggcgaacgggtgagtaatgcgtgaccgacctgccccatacaccggaatagctcctggaaacgggtggtaatgccggatgttccagttgatcgcatggtcttctgggaaagctttcgcggtatgggatggggtcgcgtcctatcagcttgacggcggggtaacggcccaccgtggcttcgacgggtagccggcctgagagggcgaccggccacattgggactgagatacggcccagactcctacgggaggcagcagtggggaatattgcacaatgggcgcaagcctgatgcagcgacgccgcgtgagggatggaggccttcgggttgtaaacctcttttatcggggagcaagcgtgagtgagtttacccgttgaataagcaccggctaactacgtgccagcagccgcggtaatacgtagggtgcaagcgttatccggaattattgggcgtaaagggctcgtaggcggttcgtcgcgtccggtgtgaaagtccatcgcttaacggtggatccgcgccgggtacgggcgggcttgagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggatgctggatgtggggcccgttccacgggttccgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgacgatcccagagatggggtttcccttcggggcgggttcacaggtggtgcatggtcgtcgtcagctcgtgtcgtgagatgttgggttaagtcccgcaacgagcgcaaccctcgccccgtgttgccagcggattgtgccgggaactcacgggggaccgccggggttaactcggaggaaggtggggatgacgtcagatcatcatgccccttacgtccagggcttcacgcatgctacaatggccggtacaacgggatgcgacgcggcgacgcggagcggatccctgaaaaccggtctcagttcggatcgcagtctgcaactcgactgcgtgaaggcggagtcgctagtaatcgcgaatcagcaacgtcgcggtgaatgcgttcccgggccttgtacacaccgcccgtcaagtcatgaaagtgggcagcacccgaagccggtggcctaaccccttgtgggatggagccgtctaaggtgaggctcgtgattgggactaagtcgtaacaaggtagccgtaccggaaggtgcggctggatcacctcctttct

SEQ ID NO: 107 - DNA, 1536 bp, Artificial Sequence
  Bifidobacterium_longum
tttttgtggagggttcgattctggctcaggatgaacgctggcggcgtgcttaacacatgcaagtcgaacgggatccatcaggctttgcttggtggtgagagtggcgaacgggtgagtaatgcgtgaccgacctgccccatacaccggaatagctcctggaaacgggtggtaatgccggatgctccagttgatcgcatggtcttctgggaaagctttcgcggtatgggatggggtcgcgtcctatcagcttgacggcggggtaacggcccaccgtggcttcgacgggtagccggcctgagagggcgaccggccacattgggactgagatacggcccagactcctacgggaggcagcagtggggaatattgcacaatgggcgcaagcctgatgcagcgacgccgcgtgagggatggaggccttcgggttgtaaacctcttttatcggggagcaagcgagagtgagtttacccgttgaataagcaccggctaactacgtgccagcagccgcggtaatacgtagggtgcaagcgttatccggaattattgggcgtaaagggctcgtaggcggttcgtcgcgtccggtgtgaaagtccatcgcttaacggtggatccgcgccgggtacgggcgggcttgagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggatgctggatgtggggcccgttccacgggttccgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgacggtcgtagagatacggcttcccttcggggcgggttcacaggtggtgcatggtcgtcgtcagctcgtgtcgtgagatgttgggttaagtcccgcaacgagcgcaaccctcgccccgtgttgccagcggattatgccgggaactcacgggggaccgccggggttaactcggaggaaggtggggatgacgtcagatcatcatgccccttacgtccagggcttcacgcatgctacaatggccggtacaacgggatgcgacgcggcgacgcggagcggatccctgaaaaccggtctcagttcggatcgcagtctgcaactcgactgcgtgaaggcggagtcgctagtaatcgcgaatcagcaacgtcgcggtgaatgcgttcccgggccttgtacacaccgcccgtcaagtcatgaaagtgggcagcacccgaagccggtggcctaaccccttgtgggatggagccgtctaaggtgaggctcgtgattgggactaagtcgtaacaaggtagccgtaccggaaggtgcggctggatcacctcctttctacggag

SEQ ID NO: 108 - DNA, 1362 bp, Artificial Sequence
  Bifidobacterium_longum
ttgcttggtggtgagagtggcgaacgggtgagtaatgcgtgaccgacctgccccatacaccggaatagctcctggaaacgggtggtaatgccggatgttccagttgatcgcatggtcttctgggaaagctttcgcggtatgggatggggtcgcgtcctatcagcttgacggcggggtaacggcccaccgtggcttcgacgggtagccggcctgagagggcgaccggccacattgggactgagatacggcccagactcctacgggaggcagcagtggggaatattgcacaatgggcgcaagcctgatgcagcgacgccgcgtgagggatggaggccttcgggttgtaaacctcttttatcggggagcaagcgwgagtgagtttacccgttgaataagcaccggctaactacgtgccagcagccgcggtaatacgtagggtgcaagcgttatccggaattattgggcgtaaagggctcgtaggcggttcgtcgcgtccggtgtgaaagtccatcgcttaacggtggatccgcgccgggtacgggcgggcttgagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggatgctggatgtggggcccgttccacgggttccgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgacgrtcsyagagatggggyttcccttcggggcgggttcacaggtggtgcatggtcgtcgtcagctcgtgtcgtgagatgttgggttaagtcccgcaacgagcgcaaccctcgccccgtgttgccagcggattrtgccgggaactcacgggggaccgccggggttaactcggaggaaggtggggatgacgtcagatcatcatgccccttacgtccagggcttcacgcatgctacaatggccggtacaacgggatgcgacgcggcgacgcggagcggatccctgaaaaccggtctcagttcggatcgcagtctgcaactcgactgcgtgaaggcggagtcgctagtaatcgcgaatcagcaacgtcgcggtgaatgcgttcccgggccttgtacacaccgcccgtcaagtcatgaaagtgggcagcacccgaagccggtggcctaaccccttgtgggatgga

SEQ ID NO: 109 - DNA, 1530 bp, Artificial Sequence
  Bifidobacterium_longum
tttttgtggagggttcgattctggctcaggatgaacgctggcggcgtgcttaacacatgcaagtcgaacgggatccatcaggctttgcttggtggtgagagtggcgaacgggtgagtaatgcgtgaccgacctgccccatacaccggaatagctcctggaaacgggtggtaatgccggatgctccagttgatcgcatggtcttctgggaaagctttcgcggtatgggatggggtcgcgtcctatcagcttgacggcggggtaacggcccaccgtggcttcgacgggtagccggcctgagagggcgaccggccacattgggactgagatacggcccagactcctacgggaggcagcagtggggaatattgcacaatgggcgcaagcctgatgcagcgacgccgcgtgagggatggaggccttcgggttgtaaacctcttttatcggggagcaagcgagagtgagtttacccgttgaataagcaccggctaactacgtgccagcagccgcggtaatacgtagggtgcaagcgttatccggaattattgggcgtaaagggctcgtaggcggttcgtcgcgtccggtgtgaaagtccatcgcttaacggtggatccgcgccgggtacgggcgggcttgagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggatgctggatgtggggcccgttccacgggttccgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgacggtcgtagagatacggcttcccttcggggcgggttcacaggtggtgcatggtcgtcgtcagctcgtgtcgtgagatgttgggttaagtcccgcaacgagcgcaaccctcgccccgtgttgccagcggattatgccgggaactcacgggggaccgccggggttaactcggaggaaggtggggatgacgtcagatcatcatgccccttacgtccagggcttcacgcatgctacaatggccggtacaacgggatgcgacgcggcgacgcggagcggatccctgaaaaccggtctcagttcggatcgcagtctgcaactcgactgcgtgaaggcggagtcgctagtaatcgcgaatcagcaacgtcgcggtgaatgcgttcccgggccttgtacacaccgcccgtcaagtcatgaaagtgggcagcacccgaagccggtggcctaaccccttgtgggatggagccgtctaaggtgaggctcgtgattgggactaagtcgtaacaaggtagccgtaccggaaggtgcggctggatcacctcctttct

SEQ ID NO: 110 - DNA, 1529 bp, Artificial Sequence
  Bifidobacterium_longum
tttttgtggagggttcgattctggctcaggatgaacgctggcggcgtgcttaacacatgcaagtcgaacgggatccatcaagcttgcttggtggtgagagtggcgaacgggtgagtaatgcgtgaccgacctgccccatacaccggaatagctcctggaaacgggtggtaatgccggatgttccagttgatcgcatggtcttctgggaaagctttcgcggtatgggatggggtcgcgtcctatcagcttgacggcggggtaacggcccaccgtggcttcgacgggtagccggcctgagagggcgaccggccacattgggactgagatacggcccagactcctacgggaggcagcagtggggaatattgcacaatgggcgcaagcctgatgcagcgacgccgcgtgagggatggaggccttcgggttgtaaacctcttttatcggggagcaagcgagagtgagtttacccgttgaataagcaccggctaactacgtgccagcagccgcggtaatacgtagggtgcaagcgttatccggaattattgggcgtaaagggctcgtaggcggttcgtcgcgtccggtgtgaaagtccatcgcttaacggtggatccgcgccgggtacgggcgggcttgagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggatgctggatgtggggcccgttccacgggttccgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgacggtcgtagagatacggcttcccttcggggcgggttcacaggtggtgcatggtcgtcgtcagctcgtgtcgtgagatgttgggttaagtcccgcaacgagcgcaaccctcgccccgtgttgccagcggattatgccgggaactcacgggggaccgccggggttaactcggaggaaggtggggatgacgtcagatcatcatgccccttacgtccagggcttcacgcatgctacaatggccggtacaacgggatgcgacgcggcgacgcggagcggatccctgaaaaccggtctcagttcggatcgcagtctgcaactcgactgcgtgaaggcggagtcgctagtaatcgcgaatcagcaacgtcgcggtgaatgcgttcccgggccttgtacacaccgcccgtcaagtcatgaaagtgggcagcacccgaagccggtggcctaaccccttgtgggatggagccgtctaaggtgaggctcgtgattgggactaagtcgtaacaaggtagccgtaccggaaggtgcggctggatcacctcctttct

SEQ ID NO: 111 - DNA, 1514 bp, Artificial Sequence
  Bifidobacterium_longum
agggttcgattctggctcaggatgaacgctggcggcgtgcttaacacatgcaagtcgaacgggatccatcaggctttgcttggtggtgagagtggcgaacgggtgagtaatgcgtgaccgacctgccccatacaccggaatagctcctggaaacgggtggtaatgccggatgctccagttgatcgcatggtcttctgggaaagctttcgcggtatgggatggggtcgcgtcctatcagcttgacggcggggtaacggcccaccgtggcttcgacgggtagccggcctgagagggcgaccggccacattgggactgagatacggcccagactcctacgggaggcagcagtggggaatattgcacaatgggcgcaagcctgatgcagcgacgccgcgtgagggatggaggccttcgggttgtaaacctcttttatcggggagcaagcgagagtgagtttacccgttgaataagcaccggctaactacgtgccagcagccgcggtaatacgtagggtgcaagcgttatccggaattattgggcgtaaagggctcgtaggcggttcgtcgcgtccggtgtgaaagtccatcgcttaacggtggatccgcgccgggtacgggcgggcttgagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggatgctggatgtggggcccgttccacgggttccgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgacggtcgtagagatacggcttcccttcggggcgggttcacaggtggtgcatggtcgtcgtcagctcgtgtcgtgagatgttgggttaagtcccgcaacgagcgcaaccctcgccccgtgttgccagcggattatgccgggaactcacgggggaccgccggggttaactcggaggaaggtggggatgacgtcagatcatcatgccccttacgtccagggcttcacgcatgctacaatggccggtacaacgggatgcgacgcggcgacgcggagcggatccctgaaaaccggtctcagttcggatcgcagtctgcaactcgactgcgtgaaggcggagtcgctagtaatcgcgaatcagcaacgtcgcggtgaatgcgttcccgggccttgtacacaccgcccgtcaagtcatgaaagtgggcagcacccgaagccggtggcctaaccccttgtgggatggagccgtctaaggtgaggctcgtgattgggactaagtcgtaacaaggtagccgtaccggaaggtgcggctggatcacct

SEQ ID NO: 112 - DNA, 1506 bp, Artificial Sequence
  Bifidobacterium_longum
gggtttcgattctggctcaggatgaacgctggcggcgtgcttaacacatgcaagtcgaacgggatccatcaagcttgcttggtggtgagagtggcgaacgggtgagtaatgcgtgaccgacctgccccatacaccggaatagctcctggaaacgggtggtaatgccggatgttccagttgatcgcatggtcttctgggaaagctttcgcggtatgggatggggtcgcgtcctatcagcttgacggcggggtaacggcccaccgtggcttcgacgggtagccggcctgagagggcgaccggccacattgggactgagatacggcccagactcctacgggaggcagcagtggggaatattgcacaatgggcgcaagcctgatgcagcgacgccgcgtgagggatggaggccttcgggttgtaaacctcttttatcggggagcaagcgtgagtgagtttacccgttgaataagcaccggctaactacgtgccagcagccgcggtaatacgtagggtgcaagcgttatccggaattattgggcgtaaagggctcgtaggcggttcgtcgcgtccggtgtgaaagtccatcgcttaacggtggatccgcgccgggtacgggcgggcttgagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggatgctggatgtggggcccgttccacgggttccgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgacggccgtagagatacggcttcccttcggggcgggttcacaggtggtgcatggtcgtcgtcagctcgtgtcgtgagatgttgggttaagtcccgcaacgagcgcaaccctcgccccgtgttgccagcggattgtgccgggaactcacgggggaccgccggggttaactcggaggaaggtggggatgacgtcagatcatcatgccccttacgtccagggcttcacgcatgctacaatggccggtacaacgggatgcgacgcggcgacgcggagcggatccctgaaaaccggtctcagttcggatcgcagtctgcaactcgactgcgtgaaggcggagtcgctagtaatcgcgaatcagcaacgtcgcggtgaatgcgttcccgggccttgtacacaccgcccgtcaagtcatgaaagtgggcagcacccgaagccggtggcctaaccccttgcgggagggagccgtctaaggtgaggctcgtgattgggactaagtcgtaacaaggtagccgtaccggaaggtgcggctgg

SEQ ID NO: 113 - DNA, 1533 bp, Artificial Sequence
  Bifidobacterium_pseudocatenulatum
tttttgtggagggttcgattctggctcaggatgaacgctggcggcgtgcttaacacatgcaagtcgaacgggatccatcaggctttgcttggtggtgagagtggcgaacgggtgagtaatgcgtgaccgacctgccccatacaccggaatagctcctggaaacgggtggtaatgccggatgctccgactcctcgcatggggtgtcgggaaagatttcatcggtatgggatggggtcgcgtcctatcaggtagtcggcggggtaacggcccaccgagcctacgacgggtagccggcctgagagggcgaccggccacattgggactgagatacggcccagactcctacgggaggcagcagtggggaatattgcacaatgggcgcaagcctgatgcagcgacgccgcgtgcgggatgacggccttcgggttgtaaaccgcttttgatcgggagcaagccttcgggtgagtgtacctttcgaataagcaccggctaactacgtgccagcagccgcggtaatacgtagggtgcaagcgttatccggaattattgggcgtaaagggctcgtaggcggttcgtcgcgtccggtgtgaaagtccatcgcttaacggtggatctgcgccgggtacgggcgggctggagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggatgctggatgtggggcccgttccacgggttccgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgacagccgtagagatatggcctcccttcggggcgggttcacaggtggtgcatggtcgtcgtcagctcgtgtcgtgagatgttgggttaagtcccgcaacgagcgcaaccctcgccctgtgttgccagcacgtcatggtgggaactcacggggggaccgccggggtcaactcggaggaaggtggggatgacgtcagatcatcatgccccttacgtccagggcttcacgcatgctacaatggccggtacaacgggatgcgacacggcgacgtggagcggatccctgaaaaccggtctcagttcggattggagtctgcaacccgactccatgaaggcggagtcgctagtaatcgcggatcagcaacgccgcggtgaatgcgttcccgggccttgtacacaccgcccgtcaagtcatgaaagtgggtagcacccgaagccggtggcctaaccctttgtggatggagccgtctaaggtgagactcgtgattgggactaagtcgtaacaaggtagccgtaccggaaggtgcggctggatcacctcctttct

SEQ ID NO: 114 - DNA, 1527 bp, Artificial Sequence
  Bifidobacterium_pseudolongum
  misc_feature (1526)..(1526): n is a, c, g, or t
ttcgattctggctcaggatgaacgctggcggcgtgcttaacacatgcaagtcgaacgggatccctggcagcttgctgccggggtgagagtggcgaacgggtgagtaatgcgtgaccgacctgccccatgcaccggaatagctcctggaaacgggtggtaatgccggatgttccacatgagcgcatgcgagtgtgggaaaggcttttgcggcatgggatggggtcgcgtcctatcagcttgttggtggggtaacggcctaccaaggcgttgacgggtagccggcctgagagggcgaccggccacattgggactgagatacggcccagactcctacgggaggcagcagtggggaatattgcacaatgggcgcaagcctgatgcagcgacgccgcgtgcgggatggaggccttcgggttgtaaaccgcttttgttcaagggcaaggcacggtttcggccgtgttgagtggattgttcgaataagcaccggctaactacgtgccagcagccgcggtaatacgtagggtgcaagcgttatccggatttattgggcgtaaagggctcgtaggcggttcgtcgcgtccggtgtgaaagtccatcgcttaacggtggatccgcgccgggtacgggcgggcttgagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggatgctggatgtggggccctttttccgggtcctgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgtgcctgacgatcccggagacggggtttcccttcggggcgggttcacaggtggtgcatggtcgtcgtcagctcgtgtcgtgagatgttgggttaagtcccgcaacgagcgcaaccctcgccgcgtgttgccagcgggtcatgccgggaactcacgtgggaccgccggggttaactcggaggaaggtggggatgacgtcagatcatcatgccccttacgtccagggcttcacgcatgctacaatggccggtacaacggggtgcgacacggtgacgtggggcggatccctgaaaaccggtctcagttcggatcgcagtctgcaactcgactgcgtgaaggtggagtcgctagtaatcgcggatcagcaacgccgcggtgaatgcgttcccgggccttgtacacaccgcccgtcaagtcatgaaagtgggcagcacccgaagacggtggcctaacccttgtggggggagccgtctaaggtgaggctcgtgattgggactaagtcgtaacaaggtagccgtaccggaaggtgcggctggatcacctcctna

SEQ ID NO: 115 - DNA, 1380 bp, Artificial Sequence
  Bifidobacterium_scardovii
gaacgctggcggcgtgcttaacacatgcaagtcgaacgggatccggccagcttgctggttggtgagagtggcgaacgggtgagtaatgcgtgaccgacctgccccatgctccggaatagctcctggaaacgggtggtaatgccggatggtccagcatgctgcatggcgtgttgggaaagatttatcggcgtgggatggggtcgcgtcctatcagcttgacggtggggtgatggcctaccgtggcttcgacgggtagccggcctgagagggcgaccggccacattgggactgagatacggcccagactcctacgggaggcagcagtggggaatattgcacaatgggcgcaagcctgatgcagcgacgccgcgtgagggatggaggccttcgggttgtaaacctcttttagcagggagcaaggcttcggttgagtgtacctgttgaataagcaccggctaactacgtgccagcagccgcggtaatacgtagggtgcaagcgttatccggaattattgggcgtaaagggctcgtaggcggttcgtcgcgtctggtgtgaaagtccatcgcttaacggtggatctgcgccgggtacgggcgggctggagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggacgctggatgtggggcccattccacgggttccgtgtcggagctaacgcgttaagcgtcccgcctggggagtacggccgcaaggctaaaactcaaagaaattgacgggggcccgcacaagcggcggagcatgcggattaattcgatgcaacgcgaagaaccttacctgggcttgacatgttcccgacggccccagagatggggcttcccttcggggcgggttcacaggtggtgcatggtcgtcgtcagctcgtgtcgtgagatgttgggttaagtcccgcaacgagcgcaaccctcgccccgtgttgccagcattttggatgggaactcacgggggaccgccggggttaactcggaggaaggtggggatgacgtcagatcatcatgcccctacgtccagggcttcacgcatgctacaatggccggtacaacgggatgcgacatggcgacatggagcggatccctgaaaaccggtctcagttcggattggagtctgcaacccgactccatgaaggcggagtcgctagtaatcgcgaatcagcaacgtcgcggtgaatgcgttcccgggccttgtacacaccgcccgtcaagtcatgaaagtgggcagcacc

SEQ ID NO: 116 - DNA, 1363 bp, Artificial Sequence
  Bifidobacterium_sp_HM2
gggttcgattctggctcaggatgaacgctggcggcgtgcttaacacatgcaagtcgaacgagtggcgaacgggtgagtaatgcgtgaccgacctgccccatgcaccggaatagctcctggaaacgggtggtaatgccggatgctgaaaggcggcatgggatggggtcgcgtcctatcagcttgatggcggggtaacggcccaccatggcttcgacgggtagccggcctgagagggcgaccggccacattgggactgagatacggcccagactcctacgggaggcagcagtggggaatattgcacaatgggcgcaagcctgatgcagcgacgccgcgtgcgggatgacggccttcgggttgtaaaccgcttttgatcgggagcatgagtgtacctttcgaataagcaccggctaactacgtgccagcagccgcggtaatacgtagggtgcaagcgttatccggaattattgggcgtaaagggctcgtaggcggttcgtcgcgtccggtgtgaaagtccatcgcttaacggtggatctgcgccgggtacgggcgggctggagtgcggtaggggagactggaattcccggtgtaacggtggaatgtgtagatatcgggaagaacaccaatggcgaaggcaggtctctgggccgactgacgctgaggagcgaaagcgtggggagcgaacaggattagataccctggtagtccacgccgtaaacggtggatgctggatgtggggcgttccgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgcacaggtggtgcatggtcgtcgtcagctcgtgtcgtgagatgttgggttaagtcccgcaacgagcgcaaccctcgccctgtgttgccagcacgtgggaactcacgggggaccgccggggtcaactcggaggaaggtggggatgacgtcagatcatcatgccccttacgtccagggcttcacgcatgctacaatggccggcaacgggatgcgacacggcgacgtggagcggatccctgccggtctcagttcggatggagtctgcaacccgactccagaaggcggagtcgctagtaatcgcggatcagcaacgccgcggtgaatgcgttcccgggccttgtacacaccgcccgtcaagtcatgaaagtgggtagcacccgaagccggtgcctatggagccgtctaaggtgagactcgtgattgggactaagtcgtaacaaggtagccgtaccggaaggtgcggctggatcacct

SEQ ID NO: 117 - DNA, 1245 bp, Artificial Sequence
  Bifidobacterium_sp_HMLN12
  misc_feature (28)..(28): n is a, c, g, or t
  misc_feature (792)..(792): n is a, c, g, or t
  misc_feature (1210)..(1210): n is a, c, g, or t
  misc_feature (1217)..(1217): n is a, c, g, or t
  misc_feature (1219)..(1219): n is a, c, g, or t
  misc_feature (1228)..(1228): n is a, c, g, or t
  misc_feature (1240)..(1241): n is a, c, g, or t
aacgggagaggatgcgtgaccgacctgncccatgcaccggaatagctcctggaaacgggtggtaatgccggatgttccacatgagcgcatgcgagtgtgggaaaggcttttgcggcatgggatggggtcgcgtcctatcagcttgttggtggggtaacggcctaccaaggcgttgacgggtagccggcctgagagggcgaccggccacattgggactgagatacggcccagactcctacgggaggcagcagtggggaatattgcacaatgggcgcaagcctgatgcagcgacgccgcgtgcgggatggaggccttcgggttgtaaaccgcttttgttcaagggcaaggcacggtttcggccgtgttgagtggattgttcgaataagcaccggctaactacgtgccagcagccgcggtaatacgtagggtgcaagcgttatccggatttattgggcgtaaagggctcgtaggcggttcgtcgcgtccggtgtgaaagtccatcgcttaacggtggatccgcgccgggtacgggcgggcttgagtgcggtaggggagactggaattcccggtgtaacggtggaatgtgtagatatcgggaagaacaccaatggcgaaggcaggtctctgggccgttactgacgctgaggagcgaaagcgtgggaagcgaacaggattagataccctggtagtccacgccgtaaacggtggatgctggatgtggggccctttttccgggtcctgtgtcggagctaacgcgttaagcatcccgcctggggagtacggccgcaaggntaaaactcaaagaaattgacgggggcccgcacaagcggcggagcatgcggattaattcgatgcaacgcgaagaaccttacctgggcttgacatgtgcctgacgatcccggagacggggtttcccttcggggcgggttcacaggtggtgcatggtcgtcagctcgtgtcgtgagatgttgggttaagtcccgcaacgagcgcaaccctcgccgcgtgttgccagcgggtcatgccgggaactcacgtgggaccgccggggttaactcggaggaaggtggggatgacgtcagatcatcatgccccttacgtccagggcttcacgcatgctacaatggccggtacaacggggtgcgacacggtgacgtggggcggatccctgaaaaccggtctcagttcggatcgcagtctgcaactcgantgctaangngcggagtcnctagtaatcgcnnatca

SEQ ID NO: 118 - DNA, 1405 bp, Artificial Sequence
  Bifidobacterium_sp_M45
  misc_feature (1215)..(1215): n is a, c, g, or t
gcttaccatgcagtcgaacgggatcccaggagcttgctcctgggtgagagtggcgaacgggtgagtaatgcgtgaccgacctgccccatacaccggaatagctcctggaaacgggtggtaatgccggatgctccagttgaatgcatgtccttctgggaaagattttgcggtatgggatggggtcgcgtcctatcagcttgatggcggggtaacggcccaccatggcttccacgggtagccggcctgagagggcgaccggccacattgggactgaaatacggcccagactcctacgggaggcagcagtggggaatattgcacaatgggcgcaagcctgatgcagcgacgccgcgtgcgggatgacggccttcgggttgtaaaccgcttttgactgggagcaagcccttcggggtgagtgtacctttcgaataagcaccggctaactacgtgccagcagccgcggtaatacgtagggtgcaagcgttatccggaattattgggcgtaaagggctcgtaagcggttcgtcgcgtccggtgtgaaagtccatcgcttaacggtggatccgcgccgggtacgggcgggcttgagtgcggtaggggagactggaattcccggtgtaacggtggaatgtgtagatatcgggaagaacaccaatggcgaaggcaggtctctgggccgtcactgacgctgaggagcgaaagcgtggggagcgaacaggattagataccctggtagtccacgccgtaaacggtggatgctggatgtggggaccattccacggtctccgtgtcggagccaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgacagccccagagatggggcctcccttcggggcgggttcacaggtggtgcatggtcgtcgtcagctcgtgtcgtgagatgttgggttaagtcccgcaacgagcgcaaccctcgccctgtgttgccagcacgtcgtggtgggaactcacgggggaccgccggggtcaactcggaggaaggtggggatgacgtcagatcatcatgccccttacgtccagggcttcacgcatgctacaatggccggtacaacgggatgcgacactgtgaggtggagcggntcccttaaaaccggtctcagttcggattggagtctgcaacccgactccatgaaggcggagtcgctagtaatcgcggatcagcaacgccgcggtgaatgcgttcccgggccttgtacacaccgcccgtcaagtcatgaaagtgggtagcacccgaagccggtggcccaaccttttgggggagccgtctaag

SEQ ID NO: 119 - DNA, 1267 bp, Artificial Sequence
  Bifidobacterium_sp_MSX5B
gctggcggcgtgcttaacacatgcaagtcgaacgagtggcgaacgggtgagtaatgcgtgaccgacctgccccatacaccggaatagctcctggaaacgggtggtaatgccggatgctgaaagtcggtatgggatggggtcgcgtcctatcagcttgatggcggggtaacggcccaccatggcttcgacgggtagccggcctgagagggcgaccggccacattgggactgagatacggcccagactcctacgggaggcagcagtggggaatattgcacaatgggcgcaagcctgatgcagcgacgccgcgtgcgggatgaaggccttcgggttgtaaaccgcttttgatcgggagcatgagtgtacccttcgaataagcaccggctaactacgtgccagcagccgcggtaatacgtagggtgcaagcgttatccggaattattgggcgtaaagggctcgtaggcggttcgtcgcgtccggtgtgaaagcccatcgcttaacggtgggtctgcgccgggtacgggcgggctggagtgcggtaggggagactggaattcccggtgtaacggtggaatgtgtagatatcgggaagaacaccaatggcgaaggcaggtctctgggccgactgacgctgaggagcgaaagcgtggggagcgaacaggattagataccctggtagtccacgccgtaaacggtggatgctggatgtggggcgttccgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgcacaggtggtgcatggtcgtcgtcagctcgtgtcgtgagatgttgggttaagtcccgcaacgagcgcaaccctcgccctgtgttgccagcacgtgggaactcacgggggaccgccggggtcaactcggaggaaggtggggatgacgtcagatcatcatgccccttacgtccagggcttcacgcatgctacaatggccggcagcgggatgcgacatggcgacatggagcggatccctgccggtctcagttcggatggagtctgcaacccgactccagaaggcggagtcgctagtaatcgcggatcagcaacgccgcggtgaatgcgttcccgggccttgtacacaccgcccgtcaagtcatgaaagtgggcagcacccgaagccggtgcctatggagccgtct

SEQ ID NO: 120 - DNA, 1303 bp, Artificial Sequence
  Bifidobacterium_sp_TM_7
tggctcaggatgaacgctggcggcgtgcttaacacatgcaagtcgaacgagtggcgaacgggtgagtaatgcgtgaccgacctgccccatacaccggaatagctcctggaaacgggtggtaatgccggatgctgaaagtcggtatgggatggggtcgcgtcctatcagcttgatggcggggtaacggcccaccatggcttcgacgggtagccggcctgagagggcgaccggccacattgggactgagatacggcccagactcctacgggaggcagcagtggggaatattgcacaatgggcgcaagcctgatgcagcgacgccgcgtgcgggatgacggccttcgggttgtaaaccgcttttgactgggagcatgagtgtacctttcgaataagcaccggctaactacgtgccagcagccgcggtaatacgtagggtgcaagcgttatccggaattattgggcgtaaagggctcgtaggcggttcgtcgcgtccggtgtgaaagtccatcgcttaacggtggatccgcgccgggtacgggcgggcttgagtgcggtaggggagactggaattcccggtgtaacggtggaatgtgtagatatcgggaagaacaccaatggcgaaggcaggtctctgggccgactgacgctgaggagcgaaagcgtggggagcgaacaggattagataccctggtagtccacgccgtaaacggtggatgctggatgtggggatctccgtgtcggagccaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgcacaggtggtgcatggtcgtcgtcagctcgtgtcgtgagatgttgggttaagtcccgcaacgagcgcaaccctcgccctgtgttgccagcacgtgggaactcacgggggaccgccggggtcaactcggaggaaggtggggatgacgtcagatcatcatgccccttacgtccagggcttcacgcatgctacaatggccggcaacgggatgcgacactgtgaggtggagcggatcccttccggtctcagttcggatggagtctgcaacccgactccagaaggcggagtcgctagtaatcgcggatcagcaacgccgcggtgaatgcgttcccgggccttgtacacaccgcccgtcaagtcatgaaagtgggtagcacccgaagccggtgcccagggagccgtctaaggtgagactcgtgattggg

SEQ ID NO: 121 - DNA, 1392 bp, Artificial Sequence
  Bifidobacterium_thermophilum
tggctcaggatgaacgctggcggcgtgcttaacacatgcaagtcgaacgggatcctgcaagcttgcttgcgggtgagagtggcgaacgggtgagtaatgcgtgaccaacctgccccatgctccggaatagctcctggaaacgggtggtaatgccggatgtgccgggctcctgcatgggggtccgggaaagctctggcggcgtgggatggggtcgcgtcctatcagcttgttggcggggtgagggcccaccaaggcttcgacgggtagccggcctgagagggcgaccggccacattgggactgagatacggcccagactcctacgggaggcagcagtggggaatattgcacaatgggcgcaagcctgatgcagcgacgccgcgtgcgggatggaggccttcgggttgtaaaccgcttttgtttgggagcaagcccttcggggtgagtgtacctttcgaataagcaccggctaactacgtgccagcagccgcggtaatacgtagggtgcgagcgttatccggatttattgggcgtaaagggctcgtaggcggttcgtcgcgtccggtgtgaaagtccatcgcctaacggtggatctgcgccgggtacgggcgggctggagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggatgctggatgtggggcccttccacgggtcccgtgtcggagccaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgacgacggcggagacgtcgtttcccttcggggcgggttcacaggtggtgcatggtcgtcgtcagctcgtgtcgtgagatgttgggtcaagtcccgcaacgagcgcaaccctcgccccgtgttgccagcgcgtcatggcgggaactcacgggggaccgccggggttaacccgggaggaaggtggggatgacgtcagatcatcatgccccttacgtccagggcttcacgcatgctacaatggccggtacaacgggatgcgacatggcgacatggagcggatccctgaaaaccggtctcagttcggatcggagcctgcaacccggctccgtgaaggcggagtcgctagtaatcgcggatcagcaacgccgcggtgaatgcgttcccgggccttgtacacaccgcccgtcaagtcatgaaagtgggcagc

SEQ ID NO: 122 - DNA, 1493 bp, Artificial Sequence
  Blautia_coccoides
agagtttgatcctggctcaggatgaacgctggcggcgtgcttaacacatgcaagtcgagcgaagcgctaagacagatttcttcggattgaagtctttgtgactgagcggcggacgggtgagtaacgcgtgggtaacctgcctcatacagggggataacagttagaaatgactgctaataccgcataagcgcacaggaccgcatggtctggtgtgaaaaactccggtggtatgagatggacccgcgtctgattagctagttggaggggtaacggcccaccaaggcgacgatcagtagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggaagagcaagtctgatgtgaaaggctggggcttaaccccaggactgcattggaaactgttgttctagagtgccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcgggtggcaaagccattcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatccctctgaccgtcccgtaacgggggcttcccttcggggcagaggagacaggtggtgcatggttgtcgtcagctcgtgtcgtgagatgttgggttaagtcccgcaacgagcgcaacccttatccttagtagccagcacatgatggtgggcactctagggagactgccggggataacccggaggaaggcggggacgacgtcaaatcatcatgccccttatgatttgggctacacacgtgctacaatggcgtaaacaaagggaagcgagacagcgatgttgagcgaatcccaaaaataacgtcccagttcggactgcagtctgcaactcgactgcacgaagctggaatcgctagtaatcgcggatcagaatgccgcggtgaatacgttcccgggtcttgtacacaccgcccgtcacaccatgggagtcagtaacgcccgaagtcagtgacctaaccgaaaggaaggagctgccgaaggcgggaccgataactggggtgaagtcgtaacaaggtaacc

SEQ ID NO: 123 - DNA, 1491 bp, Artificial Sequence
  Blautia_glucerasea
agagtttgatcctggctcaggatgaacgctggcggcgtgcttaacacatgcaagtcgaacgagaaacattttaatgaagcttcggcagatttagtttgtttctagtggcggacgggtgagtaacgcgtgggtaacctgcctcacactgggggataacagtcagaaatgactgctaataccgcataagcgcacggaaccgcatggttttgtgtgaaaaactccggtggtgtgagatggacccgcgttggattagccagttggcagggtaacggcctaccaaagcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagataatgacggtacctgactaagaagccccggctaactacgtgccagcagccgcggtaatacgtagggggcaagcgttatccggatttactgggtgtaaagggagcgtagacggagcagcaagtctgatgtgaaaggcaggggctcaacccctggactgcattggaaactgttgatcttgagtaccggaggggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcgggtggcagagccattcggtgccgcagcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatccctctgaccggtccttaaccggacctttccttcgggacagaggagacaggtggtgcatggttgtcgtcagctcgtgtcgtgagatgttgggttaagtcccgcaacgagcgcaacccctatccccagtagccagcatttaaggtgggcactctgaggagactgccagggataacctggaggaaggcggggatgacgtcaaatcatcatgccccttatgatttgggctacacacgtgctacaatggcgtaaacaaagggaagcagagcggtgacgccgagcaaatcccaaaaataacgtcccagttcggactgcagtctgcaactcgactgcacgaagctggaatcgctagtaatcgcggatcagaatgccgcggtgaatacgttcccgggtcttgtacacaccgcccgtcacaccatgggagtcagtaacgcccgaagtcagtgacctaaccgaaagggaggagctgccgaaggcgggacggatgactggggtgaagtcgtaacaaggtaacc

SEQ ID NO: 124 - DNA, 1468 bp, Artificial Sequence
  Blautia_glucerasei
  misc_feature (990)..(990): n is a, c, g, or t
ctcaggatgaacgctggcggcgtgcttaacacatgcaagtcgaacgagaaacattttaatgatagcttcggcagatttagtttgtttctagtggcggacgggtgagtaacgcgtgggtaacctgcctcacactgggggataacagtcagaaatgactgctaataccgcataagcgcacggaaccgcatggttttgtgtgaaaaactccggtggtgtgagatggacccgcgttggattagccagttggcagggtaacggcctaccaaagcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagataatgacggtacctgactaagaagccccggctaactacgtgccagcagccgcggtaatacgtagggggcaagcgttatccggatttactgggtgtaaagggagcgtagacggagcagcaagtctgatgtgaaaggcaggggctcaacccctggactgcattggaaactgttgatcttgagtaccggaggggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcgggtggcagagccattcggtgccgcagcaaacgcagtaagtattccacctggggagtacgttcgcaagaatgaaactcaaaggaattgacggggacccgcacaagcggtggagcatgtggtttaattcgaagcaacgcgaagaaccttaccagagtcttgacatccctctgaccggtccttaaccgganctttccttcgggacagaggagacaggtggtgcatggttgtcgtcagctcgtgtcgtgagatgttgggttaagtcccgcaacgagcgcaacccctatccccagtagccagcatttaaggtgggcactctgaggagactgccagggataacctggaggaaggcggggatgacgtcaaatcatcatgccccttatgatttgggctacacacgtgctacaatggcgtaaacaaagggaagcagagcggtgacgccgagcaaatcccaaaaataacgtcccagttcggactgcagtctgcaactcgactgcacgaagctggaatcgctagtaatcgcggatcagaatgccgcggtgaatacgttcccgggtcttgtacacaccgcccgtcacaccatgggagtcagtaacgcccgaagtcagtgacctaaccgaaagggaggagctgccgaaggcgggacggatgactggggtgaagtcgaac

SEQ ID NO: 125 - DNA, 1157 bp, Artificial Sequence
  Blautia_hansenii
agagtttgatcctggctcaggatgaacgctggcggcgtgcttaacacatgcaagtcgagcgaagcacttatcattgactcttcggaagatttgatatttgactgagcggcggacgggtgagtaacgcgtgggtaacctgcctcatacaggggaataacagttagaaatggctgctaatgccgcataagcgcacaggatcgcatggtctggtgtgaaaaactgaggtggtatgagatggacccgcgtctgattaggtagttggtggggtaacggcctaccaagccgacgatcagtagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggaagagcaagtctgatgtgaaaggctggggcttaaccccaggactgcattggaaactgtttttctagagtgccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcggggtgcaaagcagttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatctgcctgaccgttccttgaccggagctttccttcgggacaggcaagacaggtggtgcatggttgtcgtcagctcgtgtcgtgagatgttgggttaagtcccgcaacgagcgcaacccctatccttagtagccagcagttcggctgggcactctagggagactgccggggataacccgg

SEQ ID NO: 126 - DNA, 1530 bp, Artificial Sequence
  Blautia_hydrogenotrophica
gagagtttgatcctggctcaggatgaacgctggcggcgtgcttaacacatgcaagtcgaacgaagcgatagagaacggagatttcggttgaagttttctattgactgagtggcggacgggtgagtaacgcgtgggtaacctgccctatacagggggataacagttagaaatgactgctaataccgcataagcgcacagcttcgcatgaagcggtgtgaaaaactgaggtggtataggatggacccgcgttggattagctagttggtgaggtaacggcccaccaaggcgacgatccatagccggcctgagagggtgaacggccacattgggactgagacacggcccaaactcctacgggaggcagcagtggggaatattgcacaatgggggaaaccctgatgcagcgacgccgcgtgaaggaagaagtatctcggtatgtaaacttctatcagcagggaagaaagtgacggtacctgactaagaagccccggctaattacgtgccagcagccgcggtaatacgtaaggggcaagcgttatccggatttactgggtgtaaagggagcgtagacggtttggcaagtctgatgtgaaaggcatgggctcaacctgtggactgcattggaaactgtcagacttgagtgccggagaggcaagcggaattcctagtgtagcggtgaaatgcgtagatattaggaggaacaccagtggcgaaggcggcctgctggacggtaactgacgttgaggctcgaaagcgtggggagcaaacaggattagataccctggtagtccacgctgtaaacgatgaatactaggtgtcgggtggcaaagccattcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaaatcttgacatccctctgaccgggaagtaatgttcccttttcttcggaacagaggagacaggtggtgcatggttgtcgtcagctcgtgtcgtgagatgttgggttaagtcccgcaacgagcgcaacccttattcttagtagccagcaggtagagctgggcactctagggagactgccagggataacctggaggaaggtggggatgacgtcaaatcatcatgccccttatgatttgggctacacacgtgctacaatggcgtaaacaaagggaagcgaaggggtgacctggagcaaatctcaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgaaaggagggagctgccgaaggtgggactgataactggggtgaagtcgtaacaaggtagccgtatcggaaggtgcggctggatcacctcctttct

SEQ ID NO: 127 - DNA, 1481 bp, Artificial Sequence
  Blautia_luti
ctggctcaggatgaacgctggcggcgtgcttaacacatgcaagtcgaacgggaawtattttattgaaacttcggtsgatttaatttaattctagtggcggacgggtgagtaacgcgtgggtaacctgccttatacagggggataacagtcagaaatgactgctaataccgcataagcgcacagagctgcatggctcagtgtgaaaaactccggtggtataagatggacccgcgttggattagctrgttggtggggtaacggcccaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggtgtggcaagtctgatgtgaaaggcatgggctcaacctgtggactgcattggaaactgycatacttgagtgccggaggggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcggggagcatggctcttcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaaatcttgacatccctctgaccggtctttaatcggacctttccttcgggacaggggagacaggtggtgcatggttgtcgtcagctcgtgtcgtgagatgttgggttaagtcccgcaacgagcgcaacccctatcctcagtagccagcaagttaagttgggcactctgtggagactgccagggataacctggaggaaggcggggatgacgtcaaatcatcatgccccttatgatttgggctacacacgtgctacaatggcgtaaacaaagggaagcgagakkgtgasatggagcaaatcccaaaaataacgtcccagttcggactgtagtctgcaacccgactacacgaagctggaatcgctagtaatcgcggatcagaatgccgcggtgaatacgttcccgggtcttgtacacaccgcccgtcacaccatgggagtcagtaacgcccgaagtcagtgacctaaccgaaagggaggagctgccgaaggcgggaccgatgactggggtgaagtcgtaacaaggtaacc

SEQ ID NO: 128 - DNA, 1493 bp, Artificial Sequence
  Blautia_producta
agagtttgatcctggctcaggatgaacgctggcggcgtgcttaacacatgcaagtcgagcgaagcactaagacggatttcttcggattgaagtctttgtgactgagcggcggacgggtgagtaacgcgtgggtaacctgcctcatacagggggataacagttagaaatgactgctaataccgcataagcgcacaggaccgcatggtctggtgtgaaaaactccggtggtatgagatggacccgcgtctgattagctagttggaggggtaacggcccaccaaggcgacgatcagtagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggaagagcaagtctgatgtgaaaggctggggcttaaccccaggactgcattggaaactgttgttctagagtgccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcgggtggcaaagccattcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatccctctgaccgtcccgtaacggggacttcccttcggggcagaggagacaggtggtgcatggttgtcgtcagctcgtgtcgtgagatgttgggttaagtcccgcaacgagcgcaacccttatccttagtagccagcacatgatggtgggcactctagggagactgccggggataacccggaggaaggcggggacgacgtcaaatcatcatgccccttatgatttgggctacacacgtgctacaatggcgtaaacaaagggaagcgagacagcgatgttgagcgaatcccaaaaataacgtcccagttcggactgcagtctgcaactcgactgcacgaagctggaatcgctagtaatcgcggatcagaatgccgcggtgaatacgttcccgggtcttgtacacaccgcccgtcacaccatgggagtcagtaacgcccgaagtcagtgacctaaccgaaaggaaggagctgccgaaggcgggaccgataactggggtgaagtcgtaacaaggtaacc

SEQ ID NO: 129 - DNA, 1386 bp, Artificial Sequence
  Blautia_producta
  misc_feature (1379)..(1379): n is a, c, g, or t
tcgagcgaagcaattaagtggatctcttcggattgaaacttatttgactgagcggcggacgggtgagtaacgcgtgggtaacctgcctcatacagggggataacagttagaaatggctgctaataccgcataagcgcacaggaccgcatggtctggtgtgaaaaactccggtggtatgagatggacccgcgtctgattagctagttggaggggtaacggcccaccaaggcgacgatcagtagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggaagagcaagtctgatgtgaaaggctggggcttaaccccaggactgcattggaaactgtttttctagagtgccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcgggtggcaaagccattcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatccctctgaccggcccgtaacggggccttcccttcggggcagaggagacaggtggtgcatggctgtcgtcagctcgtgtcgtgagatgttgggttaagtcccgcaacgagcgcaacccctatccttagtagccagcaggttaagctgggcactctagggagactgccggggataacccggaggaaggcggggacgacgtcaaatcatcatgccccttatgatttgggctacacacgtgctacaatggcgtaaacaaagggaagcgagacagcgatgttgagcaaatcccaaaaataacgtcccagttcggactgcagtctgcaactcgactgcacgaagctggaatcgctagtaatcgcgaatcagaatgtcgcggtgaatacgttcccgggtcttgtacacaccgcccgtcacaccatgggagtcagtaacgcccgaagtcagtgacccaaccnttatagg

SEQ ID NO: 130 - DNA, 1482 bp, Artificial Sequence
  Blautia_schinkii
  misc_feature (37)..(37): n is a, c, g, or t
  misc_feature (173)..(173): n is a, c, g, or t
  misc_feature (184)..(184): n is a, c, g, or t
  misc_feature (188)..(188): n is a, c, g, or t
  misc_feature (367)..(367): n is a, c, g, or t
  misc_feature (1342)..(1342): n is a, c, g, or t
tgaacgctggcggcgtgcttaacacatgcaagtcgancggagattgatttaacagagacttcggttgaagttgttctgatcttagtggcggacgggtgagtaacgcgtgggtaacctgccttgtactgggggataacagccagaaatgactgctaataccgcataagcgcacnggaccgcatgntctngtgtgaaaaactccggtggtacaagatggacccgcgttggattagctagttggcagggcagaggcctaccaaggcgacgatccatagccggcctgagagggtgaacggccacattgggactgagacacggcccagactcctacgggaggcagcagtggggaatattgcacaatgggggnaaccctgatgcagcgacgccgcgtgaaggaagaagtatctcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggtatagcaagtctgatgtgaaaggcaggggctcaacccctggactgcattggaaactgttaaacttgagtgccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcgggtggcaaagccattcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatccccctgaccggtccgtaacgggacctttccttcgggacaggggagacaggtggtgcatggttgtcgtcagctcgtgtcgtgagatgttgggttaagtcccgcaacgagcgcaacccctatccttagtagccagcggtttggccgggcactctagggagactgccagggataacctggaggaaggtggggatgacgtcaaatcatcatgccccttatgatttgggctacacacgtgctacaatggcgtaaacaaagggaagcgaccgggtgaccgtgagcaaatcccaaaaataacgtcccagttcggactgtagtctgcaacccgactacacgaagctggaatcgctagtaatcgcggatcagaatgccgcggtgaatacgtncccgggtcttgtacacaccgcccgtcacaccatgggagtcagtaacgcccgaagtcagtgacctaaccgaaagggaggagctgccgaaggcgggaccgatgactggggtgaagtcgtaacaaggtagccgtatcggaagg

SEQ ID NO: 131 - DNA, 1262 bp, Artificial Sequence
  Blautia_sp_M25
ataacagccagaaatgactgctaataccgcataagcgcacagaaccgcatggttcggtgtgaaaaactccggtggtataagatggacccgcgttggattagctagttggcagggcagcggcctaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagataatgacggtacctgactaagaagccccggctaactacgtgccagcagccgcggtaatacgtagggggcaagcgttatccggatttactgggtgtaaagggagcgtagacggcgcagcaagtctgatgtgaaaggcaggggcttaacccctggactgcattggaaactgctgtgcttgagtgccggaggggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcagggagcacagctctttggtgccgccgcaaacgcattaagtattccacctggggagtacgttcgcaagaatgaaactcaaaggaattgacggggacccgcacaagcggtggagcatgtggtttaattcgaagcaacgcgaagaaccttaccaaatcttgacatccctctgaccgggacttaaccgtccctttccttcgggacaggggagacaggtggtgcatggttgtcgtcagctcgtgtcgtgagatgttgggttaagtcccgcaacgagcgcaacccctatccttagtagccagcacgcartggtgggcactctgaggagactgccagggataacctggaggaaggcggggatgacgtcaaatcatcatgccccttatgatttgggctacacacgtgctacaatggcgtaaacaaagggaagcgaacccgcgagggtgggcaaatctcaaaaataacgtcccagttcggactgcagtctgcaactcgactgcacgaagctggaatcgctagtaatcgcggatcagaatgccgcggtgaatacgttcccgggtcttgtacacaccgcccgtcacaccatgggagtcagtaacgcccg

SEQ ID NO: 132 - DNA, 1372 bp, Artificial Sequence
  Blautia_stercoris
tgcaagtcgagcgaagcgcttacgacagaaccttcgggggaagatgtaagggactgagcggcggacgggtgagtaacgcgtgggtaacctgcctcatacagggggataacagttggaaacggctgctaataccgcataagcgcacggtatcgcatgatacagtgtgaaaaactccggtggtatgagatggacccgcgtctgattagctagttggaggggtaacggcccaccaaggcgacgatcagtagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggaagagcaagtctgatgtgaaaggctggggcttaaccccaggactgcattggaaactgtttttcttgagtgccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgttggggagcaaagctcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcgatctgaccggttcgtaatggaacctttccttcgggacagagaagacaggtggtgcatggttgtcgtcagctcgtgtcgtgagatgttgggttaagtcccgcaacgagcgcaacccctatcctcagtagccagcaggtgaagctgggcactctgtggagactgccagggataacctggaggaaggcggggacgacgtcaaatcatcatgccccttatgatttgggctacacacgtgctacaatggcgtaaacaaagggaagcgagcccgcgagggggagcaaatcccaaaaataacgtcccagttcggactgcagtctgcaactcgactgcacgaagctggaatcgctagtaatcgcgaatcagaatgtcgcggtgaatacgttcccgggtcttgtacacaccgcccgtcacaccatgggagtcagtaacgcccgaagtc

SEQ ID NO: 133 - DNA, 1438 bp, Artificial Sequence
  Blautia_wexlerae
  misc_feature (19)..(19): n is a, c, g, or t
caagtcgaacgggaattantttattgaaacttcggtcgatttaatttaattctagtggcggacgggtgagtaacgcgtgggtaacctgccttatacagggggataacagtcagaaatggctgctaataccgcataagcgcacagagctgcatggctcagtgtgaaaaactccggtggtataagatggacccgcgttggattagcttgttggtggggtaacggcccaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggtgtggcaagtctgatgtgaaaggcatgggctcaacctgtggactgcattggaaactgtcatacttgagtgccggaggggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaataactaggtgtcgggtggcaaagccattcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatccgcctgaccgatccttaaccggatctttccttcgggacaggcgagacaggtggtgcatggttgtcgtcagctcgtgtcgtgagatgttgggttaagtcccgcaacgagcgcaacccctatcctcagtagccagcatttaaggtgggcactctggggagactgccagggataacctggaggaaggcggggatgacgtcaaatcatcatgccccttatgatttgggctacacacgtgctacaatggcgtaaacaaagggaagcgagattgtgagatggagcaaatcccaaaaataacgtcccagttcggactgtagtctgcaacccgactacacgaagctggaatcgctagtaatcgcggatcagaatgccgcggtgaatacgttcccgggtcttgtacacaccgcccgtcacaccatgggagtcagtaacgcccgaagtcagtgacctaactgcaaagaaggagctgccgaaggcgggaccgatgactggggtgaagtcgtaacaaggt

SEQ ID NO: 134 - DNA, 1240 bp, Artificial Sequence
  Butyrivibrio_fibrisolvens
gagtaacgcgtgggtaacctaccttgtacagggggacaacagttggaaacgactgctaataccgcataagcgcacagcatcgcatgatgcagtgtgaaaagttttttcggtacaagatggacccgcgtctgattagctagttggtgaggtaacggcccaccaaggcgacgatcagtagccgacctgagagggtgaccggccacattgggactgagacacggcccaaactcctacgggaggcagcagtggggaatattgcacaatgggcgaaagcctgatgcagcgacgccgcgtgagcgaagaagtatttcggtatgtaaagctctatcagcagggaagataatgacggtacctgactaagaagcaccggctaaatacgtgccagcagccgcggtaatacgtatggtgcaagcgttatccggatttactgggtgtaaagggagcgtaggcggttttacaagtctgatgtgaaagcccggggctcaactccggtattgcattggaaactgtagaactagagtgtcggaggggtaagtggaattcctagtgtagcggtgaaatgcgtagatattaggaggaacaccagtggcgaaggcggcttactggacgattactgacgctgaggctcgaaagcgtggggagcaaacaggattagataccctggtagtccacgccgtaaacgatgaatactaggtgttggcttccatagggagtcggtgccgcagctaacgcaataagtattccacctggggagtacgttcgcaagaatgaaactcaaaggaattgacggggacccgcacaagcggtggagcatgtggtttaattcgaagcaacgcgaagaaccttaccaaatcttgacatcctcttgacaaagtatgtaatgtactcttccttcgggacaagagtgacaggtggtgcatggttgtcgtcagctcgtgtcgtgagatgttgggttaagtcccgcaacgagcgcaacccttatctttagtagccagcatttcggatgggcactctagagagactgcccgggtgaaccgggaggaaggtggggatgacgtcaaatcatcatgccccttatgatttgggctacacacgtgctacaatggcgtaaacaaagggaagcaagtaggtgactatgagcaaatctcaaaaataacgtctcagttcggattgtagtctgcaactcgactacatgaagctggaatcgctagtaatcgcgaatcagaatgtcgcggtgaat

SEQ ID NO: 135 - DNA, 1401 bp, Artificial Sequence
  Butyrivibrio_fibrisolvens
acgatcccttcggggtgacgatttgttgactgagtggcggacgggtgagtaacgcgtgggtaacctaccttgtacagggggacaacagttggaaacgactgctaataccgcataagcgcacagcttcgcatgaagcagtgtgaaaagttttttcggtacaagatggacccgcgtctgattagctagttggtgaggtaacggcccaccaaggcgacgatcagtagccgacctgagagggtgaccggccacattgggactgagacacggcccaaactcctacgggaggcagcagtggggaatattgcacaatgggcgaaagcctgatgcagcgacgccgcgtgagcgaagaagtatttcggtatgtaaagctctatcagcagggaagataatgacggtacctgactaagaagcaccggctaaatacgtgccagcagccgcggtaatacgtatggtgcaagcgttatccggatttactgggtgtaaagggagcgtaggcggttttacaagtctgatgtgaaagcccggggctcaactccggtattgcattggaaactgtagaactagagtgtcggaggggtaagtggaattcctagtgtagcggtgaaatgcgtagatattaggaggaacaccagtggcgaaggcggcttactggacgattactgacgctgaggctcgaaagcgtggggagcaaacaggattagataccctggtagtccacgccgtaaacgatgaatactaggtgttggcttccatagggagtcggtgccgcagctaacgcaataagtattccacctggggagtacgttcgcaagaatgaaactcaaaggaattgacggggacccgcacaagcggtggagcatgtggtttaattcgaagcaacgcgaagaaccttaccaaatcttgacatcccgatgacaaagcatgtaatgtgctctctcttcggagcatcggtgacaggtggtgcatggttgtcgtcagctcgtgtcgtgagatgttgggttaagtcccgcaacgagcgcaacccttgtccttagtagccagcaattcggttgggcactctagggagactgcccgggtgaaccgggaggaaggtggggatgacgtcaaatcatcatgccccttatgatttgggctacacacgtgctacaatggcgtaaacaaagggaagcaaatatgtgagtatgagcaaatctcaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagttgggaatgcccgaagtctgtgacccaaccgtaaggagggagcagccgaaggcaggctcgataactggggtg

SEQ ID NO: 136 - DNA, 1477 bp, Artificial Sequence
  Butyrivibrio_fibrisolvens
tggcggcgtgcctaacacatgcaagtcgaacggagttattcgctgatgaagcttcggcagaatcttgaataacttagtggcggacgggtgagtaacgcgtgggtaacctgcctcatacagggggatagcagttggaaacgactgataacaccgcataagcgcacagtgtcgcatgacacagtgtgaaaatatttataggtatgagatggacccgcgtctgattagctagttggtgaggtaacggcccaccaaggcgacgatcagtagccggcctgagagggcggacggccacattgggactgagacacggcccaaactcctacgggaggcagcagtgggggatattgcacaatgggcgaaagcctgatgcagcgacgccgcgtgagtgaagaagtatttcggtatgtaaagctctatcagcagggaagaaagacctcgtaagaggggatgacggtacctgagtaagaagccccggctaactacgtgccagcagccgcggtaatacgtagggggcaagcgttatccggatttactgggtgtaaagggagcgtagacggtgtatcaagtctgaagtgaaaccccacggctcaaccgtgggcttgctttggaaactggtagactagagtactggagaggtaagcggaattcctggtgtagtagtgaaatgcgtagatatcaggaagaacatcagtggcgaaggcggcttactggacagcaactgacgttgaggctcgaaagcgtggggagcaaacaggattagataccctggtagtccacgccgtaaacgatgaatactaggtgttgggagacatagtctttcagtgccggcgctaacgcaataagtattccacctggggagtacgttcgcaagaatgaaactcaaaggaattgacggggacccgcacaagcggtggagcatgtggtttaattcgaagcaacgcgaagaaccttaccaaatcttgagatccagatgaatgatgggtaatgccatcagtccttcgggacatctgagacaggtggtgcatggttgtcgtcagctcgtgtcgtgagatgttgggtcaagtcccgcaacgagcgcaacccttgtccatagtagccagcagtaagatgggcactctatggagactgccagggataacctggaggaaggtggggatgacgtcaaatcatcatgccccttatgatttgggccacacacgtgctacaatgtcgtaacaaagggaagcaaccctgcgaaggtgagcaaatcccaaaaataacgacccagttcggactgtaggctgcaacccgcctgcacgaagctggaatcgctagtaatcgcagatcagaatgctgcggtgaatacgttcccgggtcttgtacacaccgcccgtcacaccatgggagtcggaaatgcccaaagtcagtggcctaaccgtaaggagggagcttgctaaggcaggtcggataactggggtgaagtcgtaacaaggtagcc

SEQ ID NO: 137 - DNA, 1292 bp, Artificial Sequence
  Catonella_genomosp_P1_oral_clone
gatgaacgctggcggcgtgcctaacacatgcaagtcgaacgagtggcggacgggtgagtaacgcgtgggcaacctgccctatacagggggatagcagctggaaacggctggtaagaccgcataaggaaatcaggtataggatggacccgcgtccgattagccagttggcagggtaaaagcctaccaaagcgacgatcggtagccggactgagaggtcgggcggccacattgggactgagacacggcccaaactcctacgggaggcagcagtgggggatattgcacaatggaggaaactctgatgcagcgacgccgcgtgagtgaagaagtatttcggtatgtaaagctctatcagcagggaagatgacggtacctgactaagaagccccggctaactacgtgccagcagccgcggtaatacgtagggggcaagcgttatccggatttactgggtgtaaagggagcgcaggcggttttgcaagttgagagtggaagcagggggctcaaccccctgactgctcccaaaactgtaaaacttgagtatgggagaggcaggcggaattcctagtgtagcggtgaaatgcttagatattaggaagaacaccggtggcgaaggcggcctgctggaccaactgacgctgaggctcgaaagcgtgggtagcaaacaggattagataccctggtagtccacgctgtaaacgatgaatactaggtgctgggatttcggtgccgtcgcaaacgcattaagtattccacctggggagtacgttcgcgagaatgaagctcaagggaattgacggggacccgcacaagcggtggagcatgtggtttaattcgacgcaacgcgaagaaccttacccggtcttgagatcgacaggtggtgcatggttgtcgtcagctcgtgtcgtgagatgttgggttaagtcccgcaacgagcgcaacccctatttttagtagccagcggccgggcactctaaagagactgccgaggataactcggaggaaggcggggatgacgtcaaatcatcatgccccttatgaccggggctacacacgtgctacaatgtcagtcagagggaagcgaaggcgtgagtcggagcaaatctcaggctgcctcagttcggatgtagtctgcaactcgactacagaagctggaatcgctagtaatcgcaaatcagaatgttgcggtgaatacgttcccgggtcttgtacacaccgcccgtcacaccatgggagtcggaaatgcccgaagtcagtgcctaaggagctgccgaaggcaggtctggtgactg

SEQ ID NO: 138 - DNA, 1553 bp, Artificial Sequence
  Catonella_morbi
atgagagtttgatcctggctcaggacgaacgctggcggcgtgcctaatacatgcaagtcgaacgaaccgcgactgagtgcttgcacttggtcaaggtgagtggcgaacgggtgagtaacacgtgggtaacctacctcatagtgggggataacagtcggaaacgactgctaataccgcataggacatgggatcacatgattctgtgaggaaaggtggcgcaagctatcgctaagagatggacccgcggtgcattagctagttggtagggtaagggcctaccaaggcgatgatgcatagccgacctgagagggtgatcggccacattgggactgagacacggcccaaactcctacgggaggcagcagtagggaatcttccgcaatggacgcaagtctgacggagcaacgccgcgtgagtgaagaaggtcttcggatcgtaaagctctgttgttagagaagaacagcgcatagagtaactgctatgcgtgtgacggtatctaaccagaaagccacggctaactacgtgccagcagccgcggtaatacgtaggtggcgagcgttgtccggatttattgggcgtaaagggagtgtaggcggtcttttaagtctgatgtgaaagcccacggctcaaccgtggagggtcattggaaactgggagacttgagtgcagaagaggagagcggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggaggggttccacccttcagtgctggagttaacgcaataagcactccgcctggggagtacggccgcaaggctgaaactcaaaggaattgacggggacccgcacaagcggtggagcatgtggtttaattcgaagcaacgcgaagaaccttaccaggtcttgacatcccgacgaccgctctagagatagagtttttcttcggaacgtcggtgacaggtggtgcatggttgtcgtcagctcgtgtcgtgagatgttgggttaagtcccgcaacgagcgcaacccctataactagttgccagcattgagatggggactctagttagactgccggtgacaaaccggaggaaggtggggatgacgtcaaatcatcatgccccttatgacctgggctacacacgtgctacaatggatggtacaacgagcagcgaactcgcgagggtaagcgaatctctaaaagccattctcagttcggattgtagtctgcaactcgactacatgaagccggaatcgctagtaatcgcggatcagcacgccgcggtgaatacgttcccgggtcttgtacacaccgcccgtcacaccacgagagtttgtaacacccgaagccggtggcctaaccttttaggagggagccgtcgaaggtgggatagatgattggggtgaagtcgtaacaaggtagccgtatcggaaggtgcggctggatcacctcctttct

SEQ ID NO: 139 - DNA, 1215 bp, Artificial Sequence
  Catonella_morbi
gatgaacgctggcggcgtgcctaacacatgcaagtcgaacggagattacggacggaagttttcggatggaagactgtaattcttagtggcggacgggtgagtaacgcgtgggcaacctgccctatacagggggatagcagctggaaacggctggtaagaccgcataagtcggcggaaccgcatggttttgtcgggaaatgagcaatcaggtataggatggacccgcgtccgattagccagttggcagggtaaaagcctaccaaagcgacgatcggtagccggactgagaggtcgggcggccacattgggactgagacacggcccaaactcctacgggaggcagcagtgggggatattgcacaatggaggaaactctgatgcagcgacgccgcgtgagtgaagaagtatgtcggtatgtgaaagctctatcagcagggaagatgatgacggtacctgactaagaagccccggctaactacgtgccagcagccgcggtaatacgtagggggcaagcgttatccggatttactgggtgtaaagggagcgcaggcggttttgcaagttgagagtggaagcagggggctcaaccccctgactgctcccaaaactgtaaaacttgagtatgggagaggcaggcggaattcctagtgtagcggtgaaatgcttagatattaggaagaacaccggtggcgaaggcggcctgctggaccaaaactgacgctgaggctcgaaagcgtgggtagcaaacaggattagataccctggtagtccacgctgtaaacgatgaatactaggtgctgggaggcataagcctttcggtgccgtcgcaaacgcattaagtattccacctggggagtacgttcgcgagaatgaagctcaagggaattgacggggacccgcacaagcggtggagcatgtggtataattcgacgcaacgcgaaagaaccttacccgggtcttgagaatcctcctgaaatactgagttaatgtcagtagtccttcgggacaggagagacaggtggtgcatgggtgtcgtcagctcgtgtcgtgagatgttggggttaagtccgcgacgagcgcagcccctattcttagtagccagcgggtagggccgggcaccctaaagaaactgcccgaggattactcgggagggaaggcggcggatgacgtcgaatcatcatgcctcttatgaccggggctgccacgtctcaggta

SEQ ID NO: 140 - DNA, 1366 bp, Artificial Sequence
  Catonella_sp_oral_clone_FL037
gagtttgatcctggctcaggatgaacgctggcggcgtgcctaacacatgcaagtcgaacgagtggcggacgggtgagtaacgcgtgggtaacctgccccgtacagggggatagcgtcgggaaactgacggtaagaccgcatagggaaaactggtatgggatggacccgcgtccgattagccagttggcagggtaaaggcctaccaaagcttcgatcggtagccggactgagaggtcggacggccacattgggactgagacacggcccagactcctacgggaggcagcagtgggggatattgcacaatggaggaaactctgatgcagcgacgccgcgtgagtgaagaagtgctccggcatgtaaagctctttcagcagggaagatgacggtacctgaataagaagccccggctaactacgtgccagcagccgcggtaatacgtagggggcaagcgttatccggatttactgggtgtaaagggagcgcaggcggtctggcaagttgagagtggaagcagggggctcaaccccctgactgctcccaaaactgttggactggagtatgggagaggcaggcggaattcctagtgtagcggtgaaatgctcagatattaggaagaacaccggtggcgaaggcggcctgctggaccaactgacgctgaggctcgagagcgtggggagcgaacaggattagataccctggtagtccacgccgtaaacgatgaatactaggtgccgggatttcggtgccgtcgcaaacgcattgagtattccacctggggagtacgttcgcaagaatgaaactcaaaggaattgacggggacccgcgcaagcggtggagcatgtggtttaattcgaagcaacgcgaagaaccttacccggtcttgagatcgacaggtggtgcatggttgtcgtcagctcgtgtcgtgagatgttgggttaagtcccgcaacgagcgcaacccctgttcttagtagccagcggccgggcactctaaggagactgccggggataacccggaggaaggcggggatgacgtcaaatcatcatgccccttatgacttgggcgacacacgtgctacaatggcgtacaaagggaagcgagctcgtgagagtaagcgaaactcaaaacgtctcagttcggatgtagtctgcaacccgactacagaagctggaatcgctagtaatcgcagatcagcatgctgcggtgaatacgttcccgggtcttgtacacaccgcccgtcacaccatgggagtcggtaatgcccgaagccagtaaccagggagctgtcgaaggcaggactgataactggggtgaagtcgtaacaaggtagccgtatcggaaggtgcggctggaacacctcctt

SEQ ID NO: 141 - DNA, 1266 bp, Artificial Sequence
  Citrobacter_youngae
ttaaattgaagagtttgatcatggctcagattgaacgctggcggcaggcctaacacatgcaagtcgaacggtagcacagagagcttgctctcgggtgacgagtggcggacgggtgagtaatgtctgggaaactgcccgatggagggggataactactggaaacggtagctaataccgcataacgtcgcaagaccaaagagggggaccttcgggcctcttgccatcggatgtgcccagatgggattagcttgttggtggggtaacggctcaccaaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcgttgtggttaataaccgcagcgattgacgttactcgcagaagaagcaccggctaactccgtgccagcagccgcggtaatacggagggtgcaagcgttaatcggaattactgggcgtaaagcgcacgcaggcggtctgttaagtcagatgtgaaatccccgggctcaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtctatttggaggttgtgcccttgaggcgtggcttccggagctaacgcgttaaatagaccgcctggggagtacggccgcaaggttaaaactcaaatgaattgacgggggcccgcacaagcggtggagcatgtggtttaattcgatgcaacgcgaagaaccttacctggtcttgacatccacagaagttttcagagatgagaacgtgccttcgggaactgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcatatacaaagagaagcgacctcg

SEQ ID NO: 142 - DNA, 1435 bp, Artificial Sequence
  Clostridiales_sp_SM4_1
gacgaattgactgagtggcggacgggtgagtaacgcgtgggtaacctgcctcacactgggggacaacagctggaaacggctgctaataccgcataagcgcacagcttcgcatgaagcagtgtgaaaaactccggtggtgtgagatggacccgcgtctgattagctagttggtaaggtaacggcttaccaaggcgacgatcagtagccgacctgagagggtgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcgaagcaagtctgaagtgaaagcccggggctcaaccgcgggactgctttggaaactgttttgctagagtgctggagaggtaagtggaattcctagtgtagcggtgaaatgcgtagatattaggaggaacaccagtggcgaaggcggcttactggacagtaactgacgttgaggctcgaaagcgtggggagcaaacaggattagataccctggtagtccacgccgtaaacgatgaatactaggtgttggtgagcaaagctcatcggtgccgtcgcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcggaatgaccggaacttaaccgttccttttcttcggaacattccagacaggtggtgcatggttgtcgtcagctcgtgtcgtgagatgttgggttaagtcccgcaacgagcgcaacccttatcctaagtagccagcagttcggctgggcactcttgggagactgccagggataacctggaggaaggtggggatgacgtcaaatcatcatgccccttatgatttgggctacacacgtgctacaatggcgtaaacaaagggaagcgaagctgtgaagctgagcaaatctcaaaaataacgtctcagttcggattgtagtctgcaactcgactacatgaagctggaatcgctagtaatcgcggatcagaatgccgcggtgaatacgttcccgggtcttgtacacaccgcccgtcacaccatgggagtcagtaacgcccgaagtcagtgacccaaccgcaaggagggagctgccgaaggcgggaccgataactggggtgaagtcgtaacaaggtagccgtatcggaaggtgcggctggatcacctcctttct

SEQ ID NO: 143 - DNA, 1527 bp, Artificial Sequence
  Clostridium_asparagiforme
tgagagtttgatcctggctcaggatgaacgctggcggcgtgcctaacacatgcaagtcgaacgaagcattttagatgaagttttcggatggattctgagatgactgagtggcggacgggtgagtaacacgtggataacctgcctcacactgggggacaacagttagaaatgactgctaataccgcataagcgcacagtaccgcatggtacggtgtgaaaaactccggtggtgtgagatggatccgcgtctgattagccagttggcggggtaacggcccaccaaagcgacgatcagtagccgacctgagagggtgaccggccacattgggactgagacacggcccaaactcctacgggaggcagcagtggggaatattgcacaatgggcgaaagcctgatgcagcgacgccgcgtgagtgaagaagtatttcggtatgtaaagctctatcagcagggaagataatgacggtacctgactaagaagccccggctaactacgtgccagcagccgcggtaatacgtagggggcaagcgttatccggatttactgggtgtaaagggagcgtagacggcatggcaagtctgaagtgaaaacccagggctcaaccctgggactgctttggaaactgtcaagctagagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgagtgctaggtgttggggggcaaagcccttcggtgccgtcgcaaacgcaataagcactccacctggggagtacgttcgcaagaatgaaactcaaaggaattgacggggacccgcacaagcggtggagcatgtggtttaattcgaagcaacgcgaagaaccttaccaagtcttgacatccccctgaccggcgtgtaacggcgcctttccttcgggacaggggagacaggtggtgcatggttgtcgtcagctcgtgtcgtgagatgttgggttaagtcccgcaacgagcgcaacccttatccttagtagccagcattaagatgggcactctagggagactgccagggacaacctggaggaaggtggggatgacgtcaaatcatcatgccccttatgatttgggctacacacgtgctacaatggcgtaaacaaagggaagcgaccctgcgaaggtgagcaaatctcaaaaataacgtcccagttcggactgtagtctgcaacccgactacacgaagctggaatcgctagtaatcgcgaatcagaatgtcgcggtgaatacgttcccgggtcttgtacacaccgcccgtcacaccatgggagtcagcaacgcccgaagtcagtgacccaaccgaaaggagggagctgccgaaggcggggcaggtaactggggtgaagtcgtaacaaggtagccgtatcggaaggtgcggctggatcacctcctttct

SEQ ID NO: 144 - DNA, 1491 bp, Artificial Sequence
  Clostridium_bartlettii
agagtttgatcctggctcaggatgaacgctggcggcgtgcctaacacatgcaagtcgagcgatcttcttcggaagagagcggcggacgggtgagtaacgcgtgggtaacctgccctgtacacacggataacataccgaaaggtatgctaatacgggataacataagaaattcgcatgtttttcttatcaaagctccggcggtacaggatggacccgcgtctgattagctagttggtgaggtaacggctcaccaaggcgacgatcagtagccgacctgagagggtgatcggccacattggaactgagacacggtccaaactcctacgggaggcagcagtggggaatattgcacaatgggcgaaagcctgatgcagcaacgccgcgtgagcgatgaaggccttcgggtcgtaaagctctgtcctcaaggaagataatgacggtacttgaggaggaagccccggctaactacgtgccagcagccgcggtaatacgtagggggctagcgttatccggatttactgggcgtaaagggtgcgtaggcggtcttttaagtcaggagtgaaaggctacggctcaaccgtagtaagctcttgaaactggaggacttgagtgcaggagaggagagtggaattcctagtgtagcggtgaaatgcgtagatattaggaggaacaccagtagcgaaggcggctctctggactgtaactgacgctgaggcacgaaagcgtggggagcaaacaggattagataccctggtagtccacgccgtaaacgatgagtactagctgtcggaggttacccccttcggtggcgcagctaacgcattaagtactccgcctggggagtacgctcgcaagagtgaaactcaaaggaattgacggggacccgcacaagtagcggagcatgtggtttaattcgaagcaacgcgaagaaccttacctaagcttgacatccttttgaccgatgcctaatcgcatctttcccttcggggacagaagtgacaggtggtgcatggttgtcgtcagctcgtgtcgtgagatgttgggttaagtcccgcaacgagcgcaacccttgcctttagttgccatcattaagttgggcactctagagggactgccagggataacctggaggaaggtggggatgacgtcaaatcatcatgccccttatgcttagggctacacacgtgctacaatgggtggtacagagggcagcgaagtcgtgaggccaagctaatcccttaaagccattctcagttcggattgtaggctgaaactcgcctacatgaagctggagttactagtaatcgcagatcagaatgctgcggtgaatgcgttcccgggtcttgtacacaccgcccgtcacaccatgggagttgggggcgcccgaagccggctagctaaccttttggaagcggtcgtcgaaggtgaaaccaataactggggtgaagtcgtaacaaggtagccgtatcggaaggtgcggctggatcacct

SEQ ID NO: 145 - DNA, 1476 bp, Artificial Sequence
  Clostridium_bifermentans
  misc_feature (1449)..(1449): n is a, c, g, or t
catrgctcaggatgaacgctggcggcgtgcctaacacatgcaagtcgagcgatctcttcggagagagcggcggacgggtgagtaacgcgtgggtaacctgccctgtacacacggataacataccgaaaggtatactaatacgggataacatatgaaagtcgcatggcttttgtatcaaagctccggcggtacaggatggacccgcgtctgattagctagttggtaaggtaatggcttaccaaggcaacgatcagtagccgacctgagagggtgatcggccacactggaactgagacacggtccagactcctacgggaggcagcagtggggaatattgcacaatgggcgaaagcctgatgcagcaacgccgcgtgagcgatgaaggccttcgggtcgtaaagctctgtcctcaaggaagataatgacggtacttgaggaggaagccccggctaactacgtgccagcagccgcggtaatatgtagggggctagcgttatccggaattactgggcgtaaagggtgcgtaggtggttttttaagtcagaagtgaaaggctacggctcaaccgtagtaagcttttgaaactagagaacttgagtgcaggagaggagagtagaattcctagtgtagcggtgaaatgcgtagatattaggaggaataccagtagcgaaggcggctctctggactgtaactgacactgaggcacgaaagcgtggggagcaaacaggattagataccctggtagtccacgccgtaaacgatgagtactaggtgtcgggggttacccccctcggtgccgcactaacgcattaagtactccgcctgggaagtacgctcgcaagagtgaaactcaaaggaatttdcggggacccgcacaagtagcggagcatgtggtttaattcgaagcaacgcgaagaaccttacctaagcttgacatcccactgacctctccctaatcggagatttcccttcggggacagtggtgacaggtggtgcatggttgtcgtcagctcgtgtcgtgagatgttgggttaagtcccgcaacgagcgcaacccttgcctttagttgccagcattaagttgggcactctagagggactgccgaggataactcggaggaaggtggggatgacgtcaaatcatcatgccccttatgcttagggctacacacgtgctacaatgggtggtacagagggttgccaagccgcgaggtggagctaatcccttaaagccattctcagttcggattgtaggctgaaactcgcctacatgaagctggagttactagtaatcgcagatcagaatgctgcggtgaatgcgttcccgggtcttgtacacaccgcccgtcacaccatggaagttgggggcgcccgaagccggttagctaaccttttaggaagcggccgtcgaaggtgaacaaatgactggggtgaagtcgtaacaaggtanccgtatcggaaggtgcggcbggatcaa

SEQ ID NO: 146 - DNA, 1498 bp, Artificial Sequence
  Clostridium_bifermentans
  misc_feature (1)..(6): n is a, c, g, or t
nnnnnngagagtttgatcctggctcaggatgaacgctggcggcgtgcctaacacatgcaagtcgagcgatctcttcggagagagcggcggacgggtgagtaacgcgtgggtaacctgccctgtacacacggataactaaccgaaaggtatactaatacgggataacatatgaaagtcgcatggcttttgatatcaaagctccggcggtacaggatggacccgcgtgattagctagttggtaaggtaatggcttaccaaggcaacgatcagtagccgacctgagagggtgatcggccacactggaactgagacacggtccagactcctacgggaggcagcagtggggaatattgcacaatgggcgaaagcctgatgcagcaacgccgcgtgagcgatgaaggccttcgggtcgtaaagctctgtcctcaaggaagataatgacggtacttgaggaggaagccccggctaactacgtgccagcagccgcggtaatacgtagggggctagcgttatccggaattactgggcgtaaagggtgcgtaggtggttttttaagtcagaagtgaaaggctacggctcaaccgtagtaagcttttcaaactagagaacttgagtgcaggagaggagagtagaattcctagtgtagcggtgaaatgcgtagatattaggaggaataccagtagcgaaggcggctctctggactgtaactgacactgaggcacgaaagcgtggggagcaaacaggattagataccctggtagtccacgccgtaaacgatgagtactaggtgtcggggttacccccctcggtgccgcagctaacgcattaagtactccgcctgggaagtacgatcgcaagattaaaactcaaaggaattgacggggacccgcacaagtagcggagcatgtggtttaattcgaagcaacgcgaagaaccttacctaagcttgacatcccactgacctctccctaatcggagatttccttcggggacagtggtgacaggtggtgcatggttgtcgtcagctcgtgtcgtgagatgttgggttaagtcccgcaacgagcgcaacccttgcctttagttgccagcattaagttgggcactctagagggactgccgaggataactcggaggaaggtggggatgacgtcaaatcatcatgccccttatgcttagggctacacacgtgctacaatgggtggtacagagggttgccaagccgcgaggtggagctaatcccttaaagccattctcagttcggattgtaggctgaaactcgcctacatgaagctggagttactagtaatcgcagatcagaatgctgcggtgaatgcgttcccgggtcttgtacacaccgcccgtcacaccatggaagttgggggcgcccgaagccggttagctaaccttttaggaagcggccgtcgaaggtgaaaccaatgactggggtgaagtcgtaacaaggtagccgtatcggaaggtgcggctggatcacctcctt

SEQ ID NO: 147 - DNA, 1463 bp, Artificial Sequence
  Clostridium_bifermentans
agagtttgatcctggctcaggatgaacgctggcggcgtgcctaacacatgcaagtcgagcgatctcttcggagagagcggcggacgggtgagtaacgcgtgggtaacctgccctgtacacacggataacataccgaaaggtatactaatacgggataacatatgaaagtcgcatggcttttgtatcaaagctccggcggtacaggatggacccgcgtctgattagctagttggtaaggtaatggcttaccaaggcaacgatcagtagccgacctgagagggtgatcggccacactggaactgagacacggtccagactcctacgggaggcagcagtggggaatattgcacaatgggcgaaagcctgatgcagcaacgccgcgtgagcgatgaaggccttcgggtcgtaaagctctgtcctcaaggaagataatgacggtacttgaggaggaagccccggctaactacgtgccagcagccgcggtaatacgtagggggctagcgttatccggaattactgggcgtaaagggtgcgtaggtggttttttaagtcagaagtgaaaggctacggctcaaccgtagtaagcttttgaaactagagaacttgagtgcaggagaggagagtagaattcctagtgtagcggtgaaatgcgtagatattaggaggaataccagtagcgaaggcggctctctggactgtaactgacactgaggcacgaaagcgtggggagcaaacaggattagataccctggtagtccacgccgtaaacgatgagtactaggtgtcgggggttacccccctcggtgccgcagctaacgcattaagtactccgcctgggaagtacgctcgcaagagtgaaactcaaaggaattgacggggacccgcacaagtagcggagcatgtggtttaattcgaagcaacgcgaagaaccttacctaagcttgacatcccactgacctctccctaatcggagatttcccttcggggacagtggtgacaggtggtgcatggttgtcgtcagctcgtgtcgtgagatgttgggttaagtcccgcaacgagcgcaacccttgcctttagttgccagcattaagttgggcactctagagggactgccgaggataactcggaggaaggtggggatgacgtcaaatcatcatgccccttatgcttagggctacacacgtgctacaatgggtggtacagagggttgccaagccgcgaggtggagctaatcccttaaagccattctcagttcggattgtaggctgaaactcgcctacatgaagctggagttactagtaatcgcagatcagaatgctgcggtgaatgcgttcccgggtcttgtacacaccgcccgtcacaccatggaagttgggggcgcccgaagccggttagctaaccttttaggaagcggccgtcgaaggtgaaaccaatgactggggtgaagtcgtaacaaggtaacc

SEQ ID NO: 148 - DNA, 1463 bp, Artificial Sequence
  Clostridium_bifermentans
agagtttgatcctggctcaggatgaacgctggcggcgtgcctaacacatgcaagtcgagcgatctcttcggagagagcggcggacgggtgagtaacgcgtgggtaacctgccctgtacacacggataacataccgaaaggtatactaatacgggataacatacgaaagtcgcatggcttttgtatcaaagctccggcggtacaggatggacccgcgtctgattagctagttggtaaggtaatggcttaccaaggcaacgatcagtagccgacctgagagggtgatcggccacactggaactgagacacggtccagactcctacgggaggcagcagtggggaatattgcacaatgggcgaaagcctgatgcagcaacgccgcgtgagcgatgaaggccttcgggtcgtaaagctctgtcctcaaggaagataatgacggtacttgaggaggaagccccggctaactacgtgccagcagccgcggtaatacgtagggggctagcgttatccggaattactgggcgtaaagggtgcgtaggtggttttttaagtcagaagtgaaaggctacggctcaaccgtagtaagcttttgaaactagagaacttgagtgcaggagaggagagtagaattcctagtgtagcggtgaaatgcgtagatattaggaggaataccagtagcgaaggcggctctctggactgtaactgacactgaggcacgaaagcgtggggagcaaacaggattagataccctggtagtccacgccgtaaacgatgagtactaggtgtcgggggttacccccctcggtgccgcagctaacgcattaagtactccgcctgggaagtacgctcgcaagagtgaaactcaaaggaattgacggggacccgcacaagtagcggagcatgtggtttaattcgaagcaacgcgaagaaccttacctaagcttgacatcccactgacctctccctaatcggagatttcccttcggggacagtggtgacaggtggtgcatggttgtcgtcagctcgtgtcgtgagatgttgggttaagtcccgcaacgagcgcaacccttgcctttagttgccagcattaagttgggcactctagagggactgccgaggataactcggaggaaggtggggatgacgtcaaatcatcatgccccttatgcttagggctacacacgtgctacaatgggtggtacagagggttgccaagccgcgaggtggagctaatcccttaaagccattctcagttcggattgtaggctgaaactcgcctacatgaagctggagttactagtaatcgcagatcagaatgctgcggtgaatgcgttcccgggtcttgtacacaccgcccgtcacaccatggaagttgggggcgcccgaagccggttagctaaccttttaggaagcggccgtcgaaggtgaaaccaatgactggggtgaagtcgtaacaaggtaacc

SEQ ID NO: 149 - DNA, 1536 bp, Artificial Sequence
  Clostridium_bolteae
ttaaacatgagagtttgatcctggctcaggatgaacgctggcggcgtgcctaacacatgcaagtcgaacgaagcaattgaaggaagttttcggatggaattcgattgactgagtggcggacgggtgagtaacgcgtggataacctgcctcacactgggggataacagttagaaatgactgctaataccgcataagcgcacagtaccgcatggtacagtgtgaaaaactccggtggtgtgagatggatccgcgtctgattagccagttggcggggtaacggcccaccaaagcgacgatcagtagccgacctgagagggtgaccggccacattgggactgagacacggcccaaactcctacgggaggcagcagtggggaatattgcacaatgggcgaaagcctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcgaagcaagtctgaagtgaaaacccagggctcaaccctgggactgctttggaaactgttttgctagagtgtcggagaggtaagtggaattcctagtgtagcggtgaaatgcgtagatattaggaggaacaccagtggcgaaggcggcttactggacgataactgacgttgaggctcgaaagcgtggggagcaaacaggattagataccctggtagtccacgccgtaaacgatgaatgctaggtgttggggggcaaagcccttcggtgccgtcgcaaacgcagtaagcattccacctggggagtacgttcgcaagaatgaaactcaaaggaattgacggggacccgcacaagcggtggagcatgtggtttaattcgaagcaacgcgaagaaccttaccaagtcttgacatcctcttgaccggcgtgtaacggcgccttcccttcggggcaagagagacaggtggtgcatggttgtcgtcagctcgtgtcgtgagatgttgggttaagtcccgcaacgagcgcaacccttatccttagtagccagcaggtaaagctgggcactctagggagactgccagggataacctggaggaaggtggggatgacgtcaaatcatcatgccccttatgatttgggctacacacgtgctacaatggcgtaaacaaagggaagcaagacagtgatgtggagcaaatcccaaaaataacgtcccagttcggactgtagtctgcaacccgactacacgaagctggaatcgctagtaatcgcgaatcagaatgtcgcggtgaatacgttcccgggtcttgtacacaccgcccgtcacaccatgggagtcagcaacgcccgaagtcagtgacccaactcgcaagagagggagctgccgaaggcggggcaggtaactggggtgaagtcgtaacaaggtagccgtatcggaaggtgcggctggatcacctcctttct

SEQ ID NO: 150 - DNA, 1517 bp, Artificial Sequence
  Clostridium_butyricum
tttttattgagagtttgatcctggctcaggacgaacgctggcggcgtgcttaacacatgcaagtcgagcgatgaagcttcttcggaagtggattagcggcggacgggtgagtaacacgtgggtaacctgcctcatagaggggaatagcctttcgaaaggaagattaataccgcataagattgtagtaccgcatggtacagcaattaaaggagtaatccgctatgagatggacccgcgtcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgacggtcttcggattgtaaagctctgtctttagggacgataatgacggtacctaaggaggaagccacggctaactacgtgccagcagccgcggtaatacgtaggtggcaagcgttgtccggatttactgggcgtaaagggagcgtaggtggatatttaagtgggatgtgaaatactcgggcttaacctgggtgctgcattccaaactggatatctagagtgcaggagaggaaaggagaattcctagtgtagcggtgaaatgcgtagagattaggaagaataccagtggcgaaggcgcctttctggactgtaactgacactgaggctcgaaagcgtggggagcaaacaggattagataccctggtagtccacgccgtaaacgatgaatactaggtgtaggggttgtcatgacctctgtgccgccgctaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgaattactctgtaatggaggaagccacttcggtggcaggaagacaggtggtgcatggttgtcgtcagctcgtgtcgtgagatgttgggttaagtcccgcaacgagcgcaacccttattgttagttgctaccatttagttgagcactctagcgagactgcccgggttaaccgggaggaaggtggggatgacgtcaaatcatcatgccccttatgtctagggctacacacgtgctacaatggtcggtacaatgagatgcaacctcgcgagagtgagcaaaactataaaaccgatctcagttcggattgtaggctgaaactcgcctacatgaagctggagttgctagtaatcgcgaatcagaatgtcgcggtgaatacgttcccgggccttgtacacaccgcccgtcacaccatgagagttggcaatacccaaagttcgtgagctaaccgcaaggaggcagcgacctaaggtagggtcagcgattggggtgaagtcgtaacaaggtagccgtaggagaacctgcggctggatcacctcctttct

SEQ ID NO: 151 - DNA, 1434 bp, Artificial Sequence
  Clostridium_butyricum
tgcttaacacatgcaagtcgagcgatgaagctccttcgggagtggattagcggcggacgggtgagtaacacgtgggtaacctgcctcatagaggggaatagcctttcgaaaggaagattaataccgcataagattgttttaccgcatggtacagcaattaaaggagtaatccgctatgagatggacccgcgtcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgacggccttcgggttgtaaaactctgtctttggggacgataatgacggtacccaaggaggaagccacggctaactacgtgccagcagccgcggtaatacgtaggtggcaagcgttgtccggatttactgggcgtaaagggagcgtaggtggatatttaagtgggatgtgaaatactcgggcttaacctgggtgctgcattccaaactggatatctagagtgcaggagaggaaaggagaattcctagtgtagcggtgaaatgcgtagagattaggaagaataccagtggcgaaggcgcctttctggactgtaactgacactgaggctcgaaagcgtggggagcaaacaggattagataccctggtagtccacgccgtaaacgatgaatactaggtgtaggggttgtcatgacctctgtgccgccgctaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgaattactctgtaatggaggaagccacttcggtggcaggaagacaggtggtgcatggttgtcgtcagctcgtgtcgtgagatgttgggttaagtcccgcaacgagcgcaacccttattgttagttgctaccatttagttgagcactctagcgagactgcccgggttaaccgggaggaaggtggggatgacgtcaaatcatcatgccccttatgtctagggctacacacgtgctacaatggtcggtacaatgagatgcaacctcgcgagagtgagcaaaactataaaaccgatctcagttcggattgtaggctgaaactcgcctacatgaagctggagttgctagtaatcgcgaatcagaatgtcgcggtgaatacgttcccgggccttgtacacaccgcccgtcacaccatgagagttggcaatacccaaagttcgtgagctaaccgcaaggaggcagcgacctaaggtagggtcagcgattggggtgaagtcgtaacaaggta

SEQ ID NO: 152 - DNA, 1521 bp, Artificial Sequence
  Clostridium_coccoides
tttgagtttgatcctggctcaggatgaacgctggcggcgtgcttaacacatgcaagtcgagcgaagcgctaagacagatttcttcggattgaagtctttgtgactgagcggcggacgggtgagtaacgcgtgggtaacctgcctcatacagggggataacagttagaaatgactgctaataccgcataagcgcacaggaccgcatggtctggtgtgaaaaactccggtggtatgagatggacccgcgtctgattagctagttggaggggtaacggcccaccaaggcgacgatcagtagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggaagagcaagtctgatgtgaaaggctggggcttaaccccaggactgcattggaaactgttgttctagagtgccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcgggtggcaaagccattcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatccctctgaccgtcccgtaacgggggcttcccttcggggcagaggagacaggtggtgcatggttgtcgtcagctcgtgtcgtgagatgttgggttaagtcccgcaacgagcgcaacccttatccttagtagccagcacatgatggtgggcactctagggagactgccggggataacccggaggaaggcggggacgacgtcaaatcatcatgccccttatgatttgggctacacacgtgctacaatggcgtaaacaaagggaagcgagacagcgatgttgagcgaatcccaaaaataacgtcccagttcggactgcagtctgcaactcgactgcacgaagctggaatcgctagtaatcgcggatcagaatgccgcggtgaatacgttcccgggtcttgtacacaccgcccgtcacaccatgggagtcagtaacgcccgaagtcagtgacctaaccgaaaggaaggagctgccgaaggcgggaccgataactggggtgaagtcgtaacaaggtagccgtatcggaaggtgcggctggatcccc

SEQ ID NO: 153 - DNA, 1501 bp, Artificial Sequence
  Clostridium_difficile
ttgagagtttgatcctggctcaggatgaacgctggcggcgtgcctaacacatgcaagttgagcgatttacttcggtaaagagcggcggacgggtgagtaacgcgtgggtaacctaccctgtacacacggataacataccgaaaggtatgctaatacgggataatatatttgagaggcatctcttaaatatcaaaggtgagccagtacaggatggacccgcgtctgattagctagttggtaaggtaacggcttaccaaggcgacgatcagtagccgacctgagagggtgatcggccacattggaactgagacacggtccaaactcctacgggaggcagcagtggggaatattgcacaatgggcgaaagcctgatgcagcaacgccgcgtgagtgatgaaggccttcgggtcgtaaaactctgtcctcaaggaagataatgacggtacttgaggaggaagccccggctaactacgtgccagcagccgcggtaatacgtagggggctagcgttatccggatttactgggcgtaaagggtgcgtaggcggtctttcaagtcaggagtgaaaggctacggctcaaccgtagtaagctcttgaaactgggagacttgagtgcaggagaggagagtggaattcctagtgtagcggtgaaatgcgtagatattaggaggaacaccagttgcgaaggcggctctctggactgtaactgacgctgaggcacgaaagcgtggggagcaaacaggattagataccctggtagtccacgctgtaaacgatgagtactaggtgtcgggggttacccccttcggtgccgcagctaacgcattaagtactccgcctgggaagtacgctcgcaagagtgaaactcaaaggaattgacggggacccgcacaagtagcggagcatgtggtttaattcgaagcaacgcgaagaaccttacctaagcttgacatcccaatgacatctccttaatcggagagttcccttcggggacattggtgacaggtggtgcatggttgtcgtcagctcgtgtcgtgagatgttgggttaagtcccgcaacgagcgcaacccttgtctttagttgccatcattaagttgggcactctagagagactgccagggataacctggaggaaggtggggatgacgtcaaatcatcatgccccttatgcttagggctacacacgtgctacaatgggtagtacagagggttgccaagccgtaaggtggagctaatcccttaaagctactctcagttcggattgtaggctgaaactcgcctacatgaagctggagttactagtaatcgcagatcagaatgctgcggtgaatgcgttcccgggtcttgtacacaccgcccgtcacaccacgggagttggagacgcccgaagccgattatctaaccttttggaagaagtcgtcgaaggtggaatcaataactggggtgaagtcgtaacaaggtagccgtatcggaaggtgcggctggatcacctcctttct

SEQ ID NO: 154 - DNA, 1483 bp, Artificial Sequence
  Clostridium_difficile
agagtttgatcctggctcaggatgaacgctggcggcgtgcctaacacatgcaagttgagcgatttacttcggtaaagagcggcggacgggtgagtaacgcgtgggtaacctaccctgtacacacggataacataccgaaaggtatgctaatacgggataatatatttgagaggcatctcttgaatatcaaaggtgagccagtacaggatggacccgcgtctgattagctagttggtaaggtaacggcttaccaaggcgacgatcagtagccgacctgagagggtgatcggccacattggaactgagacacggtccaaactcctacgggaggcagcagtggggaatattgcacaatgggcgaaagcctgatgcagcaacgccgcgtgagtgatgaaggccttcgggtcgtaaaactctgtcctcaaggaagataatgacggtacttgaggaggaagccccggctaactacgtgccagcagccgcggtaatacgtagggggctagcgttatccggatttactgggcgtaaagggtgcgtaggcggtctttcaagtcaggagtgaaaggctacggctcaaccgtagtaagctcttgaaactgggagacttgagtgcaggagaggagagtggaattcctagtgtagcggtgaaatgcgtagatattaggaggaacaccagttgcgaaggcggctctctggactgtaactgacgctgaggcacgaaagcgtggggagcaaacaggattagataccctggtagtccacgctgtaaacgatgagtactaggtgtcgggggttacccccttcggtgccgcagctaacgcattaagtactccgcctgggaagtacgctcgcaagagtgaaactcaaaggaattgacggggacccgcacaagtagcggagcatgtggtttaattcgaagcaacgcgaagaaccttacctaagcttgacatcccaatgacatctccttaatcggagagttcccttcggggacattggtgacaggtggtgcatggttgtcgtcagctcgtgtcgtgagatgttgggttaagtcccgcaacgagcgcaacccttgtctttagttgccatcattaagttgggcactctagagagactgccagggataacctggaggaaggtggggatgacgtcaaatcatcatgccccttatgcttagggctacacacgtgctacaatgggtagtacagagggttgccaagccgtaaggtggagctaatcccttaaagctactctcagttcggattgtaggctgaaactcgcctacatgaagctggagttactagtaatcgcagatcagaatgctgcggtgaatgcgttcccgggtcttgtacacaccgcccgtcacaccacgggagttggagacgcccgaagccgattatctaaccttttggaagaagtcgtcgaaggtggaatcaataactggggtgaagtcgtaacaaggtagccgtatcggaaggtgcggctg

SEQ ID NO: 155 - DNA, 1466 bp, Artificial Sequence
  Clostridium_difficile
  misc_feature (467)..(467): n is a, c, g, or t
  misc_feature (1290)..(1290): n is a, c, g, or t
  misc_feature (1335)..(1335): n is a, c, g, or t
  misc_feature (1402)..(1402): n is a, c, g, or t
  misc_feature (1405)..(1405): n is a, c, g, or t
  misc_feature (1435)..(1435): n is a, c, g, or t
  misc_feature (1438)..(1438): n is a, c, g, or t
atcatkgctcabgatgaacgctggcggcgtgcctaacacatgcaagttgagcgatttacttcggtaaagagcggcggacgggtgagtaacgcgtgggtaacctaccctgtacacacggataacataccgaaaggtatgctaatacgggataatatatttgagaggcatctcttgaatatcaaaggtgagccagtacaggatggacccgcgtctgattagctagttggtaaggtaacggcttaccaaggcgacgatcagtagccgacctgagagggtgatcggccacattggaactgagacacggtccaaactctacgggaggcagcagtggggaatattgcacaatgggcgaaagcctgatgcagcaacgccgcgtgagtgatgaaggccttcgggtcgtaaaactctgtcctcaaggaagataatgacggtacttgaggaggaagccccggctaactacgtgccancagccgcggtaatacgtagggggctagcgttatccggatttactgggcgtaaagggtgcgtaggcggtctttcaagtcaggagtgaaaggctacggctcaaccgtagtaagctcttgaaactgggagacttgagtgcaggagaggagagtggaattcctagtgtagcggtgaaatgcgtagatattaggaggaacaccagttgcgaaggcggctctctggactgtaactgacgctgaggcacgaaagcgtggggagcaaacaggattagataccctggtagtccacgctgtaaacgatgagtactaggtgtcgggggttaccccttcggtgccgcactaacgcattaagtactccgcctgggaagtacgctcgcaagagtgaaactcaaaggaattgacggggacccgcacaagtagcggagcatgtggtttaattcgaagcaacgcgaagaaccttacctaagcttgacatcccaatgacatctccttaatcggagagttcccttcggggacattggtgacaggtggtgcatggttgtcgtcagctcgtgtcgtgagatgttgggttaagtcccgcaacgagcgcaacccttgtctttagttgccatcattaagttgggcactctagagagactgccagggataacctggaggaaggtggggatgacgtcaaatcatcatgccccttatgcttagggctacacacgtgctacaatgggtagtacagagggttgccaagccgtaaggtggagctaatcccttaaagctactctcagttcggattgtaggctgaaactcgcctacatgaagctggagttactantaatcgcaatcaaaatgctgcggtgaatgcgttcccggggtcttntacacaccgcccgtcacaccacgggagttggaaacgcccgaagccgaattatctaaccttttggaanaantcstcgaaagtggaatcaataacttgggtnaantcgtaacaaggtaaccgtatcggaaggt

SEQ ID NO: 156 - DNA, 1483 bp, Artificial Sequence
  Clostridium_difficile
agagtttgatcctggctcaggatgaacgctggcggcgtgcctaacacatgcaagttgagcgatttacttcggtaaagagcggcggacgggtgagtaacgcgtgggtaacctaccctgtacacacggataacataccgaaaggtatgctaatacgggataatatatttgagaggcatctcttgaatatcaaaggtgagccagtacaggatggacccgcgtctgattagctagttggtaaggtaacggcttaccaaggcgacgatcagtagccgacctgagagggtgatcggccacattggaactgagacacggtccaaactcctacgggaggcagcagtggggaatattgcacaatgggcgaaagcctgatgcagcaacgccgcgtgagtgatgaaggccttcgggtcgtaaaactctgtcctcaaggaagataatgacggtacttgaggaggaagccccggctaactacgtgccagcagccgcggtaatacgtagggggctagcgttatccggatttactgggcgtaaagggtgcgtaggcggtctttcaagtcaggagtgaaaggctacggctcaaccgtagtaagctcttgaaactgggagacttgagtgcaggagaggagagtggaattcctagtgtagcggtgaaatgcgtagatattaggaggaacaccagttgcgaaggcggctctctggactgtaactgacgctgaggcacgaaagcgtggggagcaaacaggattagataccctggtagtccacgctgtaaacgatgagtactaggtgtcgggggttacccccttcggtgccgcagctaacgcattaagtactccgcctgggaagtacgctcgcaagagtgaaactcaaaggaattgacggggacccgcacaagtagcggagcatgtggtttaattcgaagcaacgcgaagaaccttacctaagcttgacatcccaatgacatctccttaatcggagagctcccttcggggacattggtgacaggtggtgcatggttgtcgtcagctcgtgtcgtgagatgttgggttaagtcccgcaacgagcgcaacccttgtctttagttgccatcattaagttgggcactctagagagactgccagggataacctggaggaaggtggggatgacgtcaaatcatcatgccccttatgcttagggctacacacgtgctacaatgggtagtacagagggttgccaagccgtaaggtggagctaatcccttaaagctactctcagttcggattgtaggctgaaactcgcctacatgaagctggagttactagtaatcgcagatcagaatgctgcggtgaatgcgttcccgggtcttgtacacaccgcccgtcacaccacggaagttggagacgcccgaagccgattatctaaccttttggaagaagtcgtcgaaggtggaatcaataactggggtgaagtcgtaacaaggtagccgtatcggaaggtgcggctg

SEQ ID NO: 157 - DNA, 1483 bp, Artificial Sequence
  Clostridium_difficile
agagtttgatcctggctcaggatgaacgctggcggcgtgcctaacacatgcaagttgagcgatttacttcggtaaagagcggcggacgggtgagtaacgcgtgggtaacctaccctgtacacacggataacataccgaaaggtatgctaatacgggataatatatttgagaggcatctcttgaatatcaaaggtgagccagtacaggatggacccgcgtctgattagctagttggtaaggtaacggcttaccaaggcgacgatcagtagccgacctgagagggtgatcggccacattggaactgagacacggtccaaactcctacgggaggcagcagtggggaatattgcacaatgggcgaaagcctgatgcagcaacgccgcgtgagtgatgaaggccttcgggtcgtaaaactctgtcctcaaggaagataatgacggtacttgaggaggaagccccggctaactacgtgccagcagccgcggtaatacgtagggggctagcgttatccggatttactgggcgtaaagggtgcgtaggcggtctttcaagtcaggagtgaaaggctacggctcaaccgtagtaagctcttgaaactgggagacttgagtgcaggagaggagagtggaattcctagtgtagcggtgaaatgcgtagatattaggaggaacaccagttgcgaaggcggctctctggactgtaactgacgctgaggcacgaaagcgtggggagcaaacaggattagataccctggtagtccacgctgtaaacgatgagtactaggtgtcgggggttacccccctcggtgccgcagctaacgcattaagtactccgcctgggaagtacgctcgcaagagtgaaactcaaaggaattgacggggacccgcacaagtagcggagcatgtggtttaattcgaagcaacgcgaagaaccttacctaagcttgacatcccaatgacatctccttaatcggagagttcccttcggggacattggtgacaggtggtgcatggttgtcgtcagctcgtgtcgtgagatgttgggttaagtcccgcaacgagcgcaacccttgtctttagttgccatcattaagttgggcactctagagagactgccagggataacctggaggaaggtggggatgacgtcaaatcatcatgccccttatgcttagggctacacacgtgctacaatgggtagtacagagggttgccaagccgtaaggtggagctaatcccttaaagctactctcagttcggattgtaggctgaaactcgcctacatgaagctggagttactagtaatcgcagatcagaatgctgcggtgaatgcgttcccgggtcttgtacacaccgcccgtcacaccacgggagttggagacgcccgaagccgattatctaaccttttggaagaagtcgtcgaaggtggaatcaataactggggtgaagtcgtaacaaggtagccgtatcggaaggtgcggctg

SEQ ID NO: 158 - DNA, 1630 bp, Artificial Sequence
  Clostridium_difficile
gaacattgaaaattaaacagtaggttaatttatattaagaaacaaaccataaagccagatattttgataacaatagtatctgagcctgataaacttttatttgagagtttgatcctggctcaggatgaacgctggcggcgtgcctaacacatgcaagttgagcgatttacttcggtaaagagcggcggacgggtgagtaacgcgtgggtaacctaccctgtacacacggataacataccgaaaggtatgctaatacgggataatatatttgagaggcatctcttaaatatcaaaggtgagccagtacaggatggacccgcgtctgattagctagttggtaaggtaacggcttaccaaggcgacgatcagtagccgacctgagagggtgatcggccacattggaactgagacacggtccaaactcctacgggaggcagcagtggggaatattgcacaatgggcgaaagcctgatgcagcaacgccgcgtgagtgatgaaggccttcgggtcgtaaaactctgtcctcaaggaagataatgacggtacttgaggaggaagccccggctaactacgtgccagcagccgcggtaatacgtagggggctagcgttatccggatttactgggcgtaaagggtgcgtaggcggtctttcaagtcaggagtgaaaggctacggctcaaccgtagtaagctcttgaaactgggagacttgagtgcaggagaggagagtggaattcctagtgtagcggtgaaatgcgtagatattaggaggaacaccagttgcgaaggcggctctctggactgtaactgacgctgaggcacgaaagcgtggggagcaaacaggattagataccctggtagtccacgctgtaaacgatgagtactaggtgtcgggggttacccccttcggtgccgcagctaacgcattaagtactccgcctgggaagtacgctcgcaagagtgaaactcaaaggaattgacggggacccgcacaagtagcggagcatgtggtttaattcgaagcaacgcgaagaaccttacctaagcttgacatcccaatgacatctccttaatcggagagttcccttcggggacattggtgacaggtggtgcatggttgtcgtcagctcgtgtcgtgagatgttgggttaagtcccgcaacgagcgcaacccttgtctttagttgccatcattaagttgggcactctagagagactgccagggataacctggaggaaggtggggatgacgtcaaatcatcatgccccttatgcttagggctacacacgtgctacaatgggtagtacagagggttgccaagccgtaaggtggagctaatcccttaaagctactctcagttcggattgtaggctgaaactcgcctacatgaagctggagttactagtaatcgcagatcagaatgctgcggtgaatgcgttcccgggtcttgtacacaccgcccgtcacaccacgggagttggagacgcccgaagccgattatctaaccttttggaagaagtcgtcgaaggtggaatcaataactggggtgaagtcgtaacaaggtagccgtatcggaaggtgcggctggatcacctcctttctaaggagaattgcctactgtttaattttga

SEQ ID NO: 159 - DNA, 1483 bp, Artificial Sequence
  Clostridium_difficile
agagtttgatcctggctcaggatgaacgctggcggcgtgcctaacacatgcaagttgagcgatttacttcggtaaagagcggcggacgggtgagtaacgcgtgggtaacctaccctgtacacacggataacataccgaaaggtatgctaatacgggataatatatttgagaggcatctcttgaatatcaaaggtgagccagtacaggatggacccgcgtctgattagctagttggtaaggtaacggcttaccaaggcgacgatcagtagccgacctgagagggtgatcggccacattggaactgagacacggtccaaactcctacgggaggcagcagtggggaatattgcacaatgggcgaaagcctgatgcagcaacgccgcgtgagtgatgaaggccttcgggtcgtaaaactctgtcctcaaggaagataatgacggtacttgaggaggaagccccggctaactacgtgccagcagccgcggtaatacgtagggggctagcgttatccggatttactgggcgtaaagggtgcgtaggcggtctttcaagtcaggagtgaaaggctacggctcaaccgtagtaagctcttgaaactgggagacttgagtgcaggagaggagagtggaattcctagtgtagcggtgaaatgcgtagatattaggaggaacaccagttgcgaaggcggctctctggactgtaactgacgctgaggcacgaaagcgtggggagcaaacaggattagataccctggtagtccacgctgtaaacgatgagtactaggtgtcgggggttacccccttcggtgccgcagctaacgcattaagtactccgcctgggaagtacgctcgcaagagtgaaactcaaaggaattgacggggacccgcacaagtagcggagcatgtggtttaattcgaagcaacgcgaagaaccttacctaagcttgacatcccaatgacatctccttaatcggagagttcccttcggggacattggtgacaggtggtgcatggttgtcgtcagctcgtgtcgtgagatgttgggttaagtcccgcaacgagcgcaacccttgtctttagttgccatcattaagttgggcactctagagagactgccagggataacctggaggaaggtggggatgacgtcaaatcatcatgccccttatgcttagggctacacacgtgctacaatgggtagtacagagggttgccaagccgtaaggtggagctaatcccttaaagctactctcagttcggattgtaggctgaaactcgcctacatgaagctggagttactagtaatcgcagatcagaatgctgcggtgaatgcgttcccgggtcttgtacacaccgcccgtcacaccacgggagttggagacgcccgaagccgactatctaaccttttggaagaagtcgtcgaaggtggaatcaataactggggtgaagtcgtaacaaggtagccgtatcggaaggtgcggctg

SEQ ID NO: 160 - DNA, 1483 bp, Artificial Sequence
  Clostridium_difficile
agagtttgatcctggctcaggatgaacgctggcggcgtgcctaacacatgcaagttgagcgatttacttcggtaaagagcggcggacgggtgagtaacgcgtgggtaacctaccctgtacacacggataacataccgaaaggtatgctaatacgggataacatatttgagaggcatctcttaaatatcaaaggtgagccagtacaggatggacccgcgtctgattagctagttggtaaggtaacggcttaccaaggcgacgatcagtagccgacctgagagggtgatcggccacattggaactgagacacggtccaaactcctacgggaggcagcagtggggaatattgcacaatgggcgaaagcctgatgcagcaacgccgcgtgagtgatgaaggccttcgggtcgtaaaactctgtcctcaaggaagataatgacggtacttgaggaggaagccccggctaactacgtgccagcagccgcggtaatacgtagggggctagcgttatccggatttactgggcgtaaagggtgcgtaggcggtctttcaagtcaggagtgaaaggctacggctcaaccgtagtaagctcttgaaactgggagacttgagtgcaggagaggagagtggaattcctagtgtagcggtgaaatgcgtagatattaggaggaacaccagttgcgaaggcggctctctggactgtaactgacgctgaggcacgaaagcgtggggagcaaacaggattagataccctggtagtccacgctgtaaacgatgagtactaggtgtcgggggttacccccttcggtgccgcagctaacgcattaagtactccgcctgggaagtacgctcgcaagagtgaaactcaaaggaattgacggggacccgcacaagtagcggagcatgtggtttaattcgaagcaacgcgaagaaccttacctaagcttgacatcccaatgacatctccttaaccggagagttcccttcggggacattggtgacaggtggtgcatggttgtcgtcagctcgtgtcgtgagatgttgggttaagtcccgcaacgagcgcaacccttgtctttagttgccatcattaagttgggcactctagagagactgccagggataacctggaggaaggtggggatgacgtcaaatcatcatgccccttatgcttagggctacacacgtgctacaatgggtagtacagagggttgccaaaccgtaaggtggagctaatcccttaaagctactctcagttcggattgtaggctgaaactcgcctacatgaagctggagttactagtaatcgcagatcagaatgctgcggtgaatgcgttcccgggtcttgtacacaccgcccgtcacaccacgggagttggagacgcccgaagccgattatctaaccttttggaagaagtcgtcgaaggtggaatcaataactggggtgaagtcgtaacaaggtagccgtatcggaaggtgcggctg

SEQ ID NO: 161 - DNA, 1483 bp, Artificial Sequence
  Clostridium_difficile
agagtttgatcctggctcaggatgaacgctggcggcgtgcctaacacatgcaagttgagcgatttacttcggtaaagagcggcggacgggtgagtaacgcgtgggtaacctaccctgtacacacggataacataccgaaaggtatgctaatacgggataatatatttgagaggcatctcttgaatatcaaaggtgagccagtacaggatggacccgcgtctgattagctagttggtaaggtaaaggcttaccaaggcgacgatcagtagccgacctgagagggtgatcggccacattggaactgagacacggtccaaactcctacgggaggcagcagtggggaatattgcacaatgggcgaaagcctgatgcagcaacgccgcgtgagtgatgaaggccttcgggtcgtaaaactctgtcctcaaggaagataatgacggtacttgaggaggaagccccggctaactacgtgccagcagccgcggtaatacgtagggggctagcgttatccggatttactgggcgtaaagggtgcgtaggcggtctttcaagtcaggagtgaaaggctacggctcaaccgtagtaagctcttgaaactgggagacttgagtgcaggagaggagagtggaattcctagtgtagcggtgaaatgcgtagatattaggaggaacaccagttgcgaaggcggctctctggactgtaactgacgctgaggcacgaaagcgtggggagcaaacaggattagataccctggtagtccacgctgtaaacgatgagtactaggtgtcgggggttacccccttcggtgccgcagctaacgcattaagtactccgcctgggaagtacgctcgcaagagtgaaactcaaaggaattgacggggacccgcacaagtagcggagcatgtggtttaattcgaagcaacgcgaagaaccttacctaagcttgacatcccaatgacatctccttaatcggagagttcccttcggggacattggtgacaggtggtgcatggttgtcgtcagctcgtgtcgtgagatgttgggttaagtcccgcaacgagcgcaacccttgtctttagttgccatcattaagttgggcactctagagagactgccagggataacctggaggaaggtggggatgacgtcaaatcatcatgccccttatgcttagggctacacacgtgctacaatgggtagtacagagggttgccaagccgtaaggtggagctaatcccttaaagctactctcagttcggattgtaggctgaaactcgcctacatgaagctggagttactagtaatcgcagatcagaatgctgcggtgaatgcgttcccgggtcttgtacacaccgcccgtcacaccacgggagttggagacgcccgaagccgattatctaaccttttggaagaagtcgtcgaaggtggaatcaataactggggtgaagtcgtaacaaggtagccgtatcggaaggtgcggctg

SEQ ID NO: 162 - DNA, 1214 bp, Artificial Sequence
  Clostridium_difficile
agagtttgatcctggctcaggatgaacgctggcggcgtgcctaacacatgcaagttgagcgatttacttcggtaaagagcggcggacgggtgagtaacgcgtgggtaacctaccctgtacacacggataacataccgaaaggtatgctaatacgggataacatatttgagaggcatctcttaaatatcaaaggtgagccagtacaggatggacccgcgtctgattagctagttggtaaggtaacggcttaccaaggcgacgatcagtagccgacctgagagggtgatcggccacattggaactgagacacggtccaaactcctacgggaggcagcagtggggaatattgcacaatgggcgaaagcctgatgcagcaacgccgcgtgagtgatgaaggccttcgggtcgtaaaactctgtcctcaaggaagataatgacggtacttgaggaggaagccccggctaactacgtgccagcagccgcggtaatacgtagggggctagcgttatccggatttactgggcgtaaagggtgcgtaggcggtctttcaagtcaggagtgaaaggctacggctcaaccgtagtaagctcttgaaactgggagacttgagtgcaggagaggagagtggaattcctagtgtagcggtgaaatgcgtagatattaggaggaacaccagttgcgaaggcggctctctggactgtaactgacgctgaggcacgaaagcgtggggagcaaacaggattagataccctggtagtccacgctgtaaacgatgagtactaggtgtcgggggttacccccctcggtgccgcagctaacgcattaagtactccgcctgggaagtacgctcgcaagagtgaaactcaaaggaattgacggggacccgcacaagtagcggagcatgtggtttaattcgaagcaacgcgaagaaccttacctaagcttgacatcccaatgacatctccttaatcggagagttcccttcggggacattggtgacaggtggtgcatggttgtcgtcagctcgtgtcgtgagatgttgggttaagtcccgcaacgagcgcaacccttgtctttagttgccatcattaagttgggcactctagagagactgccagggataacctggaggaaggtggggatgacgtcaaatcatcatgccccttatgcttagggctacacacgtgctacaatgggtagtacagagggttgcc

SEQ ID NO: 163 - DNA, 1507 bp, Artificial Sequence
  Clostridium_difficile
ttttatttgagagtttgatcctggctcaggatgaacgctggcggcgtgcctaacacatgcaagttgagcgatttacttcggtaaagagcggcggacgggtgagtaacgcgtgggtaacctaccctgtacacacggataacataccgaaaggtatgctaatacgggataacatatttgagaggcatctcttgaatatcaaaggtgagccagtacaggatggacccgcgtctgattagctagttggtaaggtaacggcttaccaaggcgacgatcagtagccgacctgagagggtgatcggccacattggaactgagacacggtccaaactcctacgggaggcagcagtggggaatattgcacaatgggcgaaagcctgatgcagcaacgccgcgtgagtgatgaaggccttcgggtcgtaaaactctgtcctcaaggaagataatgacggtacttgaggaggaagccccggctaactacgtgccagcagccgcggtaatacgtagggggctagcgttatccggatttactgggcgtaaagggtgcgtaggcggtctttcaagtcaggagtgaaaggctacggctcaaccgtagtaagctcttgaaactgggagacttgagtgcaggagaggagagtggaattcctagtgtagcggtgaaatgcgtagatattaggaggaacaccagttgcgaaggcggctctctggactgtaactgacgctgaggcacgaaagcgtggggagcaaacaggattagataccctggtagtccacgctgtaaacgatgagtactaggtgtcgggggttacccccctcggtgccgcagctaacgcattaagtactccgcctgggaagtacgctcgcaagagtgaaactcaaaggaattgacggggacccgcacaagtagcggagcatgtggtttaattcgaagcaacgcgaagaaccttacctaagcttgacatcccaatgacatctccttaatcggagagttcccttcggggacattggtgacaggtggtgcatggttgtcgtcagctcgtgtcgtgagatgttgggttaagtcccgcaacgagcgcaacccttgtctttagttgccatcattaagttgggcactctagagagactgccagggataacctggaggaaggtggggatgacgtcaaatcatcatgccccttatgcttagggctacacacgtgctacaatgggtagtacagagggttgccaaaccgtaaggtggagctaatcccttaaagctactctcagttcggattgtaggctgaaactcgcctacatgaagctggagttactagtaatcgcagatcagaatgctgcggtgaatgcgttcccgggtcttgtacacaccgcccgtcacaccacgggagttggagacgcccgaagccgattatctaaccttttggaagaagtcgtcgaaggtggaatcaataactggggtgaagtcgtaacaaggtagccgtatcggaaggtgcggctggatcacctcctttct

SEQ ID NO: 164 - DNA, 1418 bp, Artificial Sequence
  Clostridium_difficile
ggcggacgggtgagtaacgcgtgggtaacctaccctgtacacacggataacataccgaaaggtatgctaatacgggataacatatttgagaggcatctcttgaatatcaaaggtgagccagtacaggatggacccgcgtctgattagctagttggtaaggtaacggcttaccaaggcgacgatcagtagccgacctgagagggtgatcggccacattggaactgagacacggtccaaactcctacgggaggcagcagtggggaatattgcacaatgggcgaaagcctgatgcagcaacgccgcgtgagtgatgaaggccttcgggtcgtaaaactctgtcctcaaggaagataatgacggtacttgaggaggaagccccggctaactacgtgccagcagccgcggtaatacgtagggggctagcgttatccggatttactgggcgtaaagggtgcgtaggcggtctttcaagtcaggagtgaaaggctacggctcaaccgtagtaagctcttgaaactgggagacttgagtgcaggagaggagagtggaattcctagtgtagcggtgaaatgcgtagatattaggaggaacaccagttgcgaaggcggctctctggactgtaactgacgctgaggcacgaaagcgtggggagcaaacaggattagataccctggtagtccacgctgtaaacgatgagtactaggtgtcgggggttacccccctcggtgccgcagctaacgcattaagtactccgcctgggaagtacgctcgcaagagtgaaactcaaaggaattgacggggacccgcacaagtagcggagcatgtggtttaattcgaagcaacgcgaagaaccttacctaagcttgacatcccaatgacatctccttaatcggagagttcccttcggggacattggtgacaggtggtgcatggttgtcgtcagctcgtgtcgtgagatgttgggttaagtcccgcaacgagcgcaacccttgtctttagttgccatcattaagttgggcactctagagagactgccagggataacctggaggaaggtggggatgacgtcaaatcatcatgccccttatgcttagggctacacacgtgctacaatgggtagtacagagggttgccaaaccgtaaggtggagctaatcccttaaagctactctcagttcggattgtaggctgaaactcgcctacatgaagctggagttactagtaatcgcagatcagaatgctgcggtgaatgcgttcccgggtcttgtacacaccgcccgtcacaccacgggagttggagacgcccgaagccgattatctaaccttttggaagaagtcgtcgaaggtggaatcaataactggggtgaagtcgtaacaaggtagccgtatcggaaggtgcggctggatcacctcctttct

SEQ ID NO: 165 - DNA, 1507 bp, Artificial Sequence
  Clostridium_difficile
ttttatttgagagtttgatcctggctcaggatgaacgctggcggcgtgcctaacacatgcaagttgagcgatttacttcggtaaagagcggcggacgggtgagtaacgcgtgggtaacctaccctgtacacacggataacataccgaaaggtatgctaatacgggataatatatttgagaggcatctcttgaatatcaaaggtgagccagtacaggatggacccgcgtctgattagctagttggtaaggtaacggcttaccaaggcgacgatcagtagccgacctgagagggtgatcggccacattggaactgagacacggtccaaactcctacgggaggcagcagtggggaatattgcacaatgggcgaaagcctgatgcagcaacgccgcgtgagtgatgaaggccttcgggtcgtaaaactctgtcctcaaggaagataatgacggtacttgaggaggaagccccggctaactacgtgccagcagccgcggtaatacgtagggggctagcgttatccggatttactgggcgtaaagggtgcgtaggcggtctttcaagtcaggagtgaaaggctacggctcaaccgtagtaagctcttgaaactgggagacttgagtgcaggagaggagagtggaattcctagtgtagcggtgaaatgcgtagatattaggaggaacaccagttgcgaaggcggctctctggactgtaactgacgctgaggcacgaaagcgtggggagcaaacaggattagataccctggtagtccacgctgtaaacgatgagtactaggtgtcgggggttacccccttcggtgccgcagctaacgcattaagtactccgcctgggaagtacgctcgcaagagtgaaactcaaaggaattgacggggacccgcacaagtagcggagcatgtggtttaattcgaagcaacgcgaagaaccttacctaagcttgacatcccaatgacatctccttaatcggagagttcccttcggggacattggtgacaggtggtgcatggttgtcgtcagctcgtgtcgtgagatgttgggttaagtcccgcaacgagcgcaacccttgtctttagttgccatcattaagttgggcactctagagagactgccagggataacctggaggaaggtggggatgacgtcaaatcatcatgccccttatgcttagggctacacacgtgctacaatgggtagtacagagggttgccaagccgtaaggtggagctaatcccttaaagctactctcagttcggattgtaggctgaaactcgcctacatgaagctggagttactagtaatcgcagatcagaatgctgcggtgaatgcgttcccgggtcttgtacacaccgcccgtcacaccacgggagttggagacgcccgaagccgattatctaaccttttggaagaagtcgtcgaaggtggaatcaataactggggtgaagtcgtaacaaggtagccgtatcggaaggtgcggctggatcacctcctttct

SEQ ID NO: 166 - DNA, 1501 bp, Artificial Sequence
  Clostridium_difficile
  misc_feature (1403)..(1403): n is a, c, g, or t
ttgagagtttgatcctggctcaggatgaacgctggcggcgtgcctaacacatgcaagttgagcgatttacttcggtaaagagcggcggacgggtgagtaacgcgtgggtaacctaccctgtacacacggataacataccgaaaggtatgctaatacgggataatatatttgagaggcatctcttaaatatcaaaggtgagccagtacaggatggacccgcgtctgattagctagttggtaaggtaacggcttaccaaggcgacgatcagtagccgacctgagagggtgatcggccacattggaactgagacacggtccaaactcctacgggaggcagcagtggggaatattgcacaatgggcgaaagcctgatgcagcaacgccgcgtgagtgatgaaggccttcgggtcgtaaaactctgtcctcaaggaagataatgacggtacttgaggaggaagccccggctaactacgtgccagcagccgcggtaatacgtagggggctagcgttatccggatttactgggcgtaaagggtgcgtaggcggtctttcaagtcaggagtgaaaggctacggctcaaccgtagtaagctcttgaaactgggagacttgagtgcaggagaggagagtggaattcctagtgtagcggtgaaatgcgtagatattaggaggaacaccagttgcgaaggcggctctctggactgtaactgacgctgaggcacgaaagcgtggggagcaaacaggattagataccctggtagtccacgctgtaaacgatgagtactaggtgtcgggggttacccccttcggtgccgcagctaacgcattaagtactccgcctgggaagtacgctcgcaagagtgaaactcaaaggaattgacggggacccgcacaagtagcggagcatgtggtttaattcgaagcaacgcgaagaaccttacctaagcttgacatcccaatgacatctccttaatcggagagttcccttcggggacgttggtgacaggtggtgcatggttgtcgtcagctcgtgtcgtgagatgttgggttaagtcccgcaacgagcgcaacccttgtctttagttgccatcattaagttgggcactctagagagactgccagggataacctggaggaaggtggggatgacgtcaaatcatcatgccccttatgcttagggctacacacgtgctacaatgggtagtacagagggttgccaagccgtaaggtggagctaatcccttaaagctactctcagttcggattgtaggctgaaactcgcctacatgaagctggagttactagtaatcgcagatcagaatgctgcggtgaatgcgttcccgggtcttgtacacaccgcccgtcacaccacgggagttggagacgcccgaagccgactatctnaccttttggaagaagtcgtcgaaggtggaatcaataactggggtgaagtcgtaacaaggtagccgtatcggaaggtgcggctggatcacctcctttct

SEQ ID NO: 167 - DNA, 1501 bp, Artificial Sequence
  Clostridium_difficile
ttgagagtttgatcctggctcaggatgaacgctggcggcgtgcctaacacatgcaagttgagcgatttacttcggtaaagagcggcggacgggtgagtaacgcgtgggtaacctaccctgtacacacggataacataccgaaaggtatgctaatacgggataatatatttgagaggcatctcttgaatatcaaaggtgagccagtacaggatggacccgcgtctgattagctagttggtaaggtaacggcttaccaaggcgacgatcagtagccgacctgagagggtgatcggccacattggaactgagacacggtccaaactcctacgggaggcagcagtggggaatattgcacaatgggcgaaagcctgatgcagcaacgccgcgtgagtgatgaaggccttcgggtcgtaaaactctgtcctcaaggaagataatgacggtacttgaggaggaagccccggctaactacgtgccagcagccgcggtaatacgtagggggctagcgttatccggatttactgggcgtaaagggtgcgtaggcggtctttcaagtcaggagtgaaaggctacggctcaaccgtagtaagctcttgaaactgggagacttgagtgcaggagaggagagtggaattcctagtgtagcggtgaaatgcgtagatattaggaggaacaccagttgcgaaggcggctctctggactgtaactgacgctgaggcacgaaagcgtggggagcaaacaggattagataccctggtagtccacgctgtaaacgatgagtactaggtgtcgggggttacccccttcggtgccgcagctaacgcattaagtactccgcctgggaagtacgctcgcaagagtgaaactcaaaggaattgacggggacccgcacaagtagcggagcatgtggtttaattcgaagcaacgcgaagaaccttacctaagcttgacatcccaatgacatctccttaatcggagagttcccttcggggacattggtgacaggtggtgcatggttgtcgtcagctcgtgtcgtgagatgttgggttaagtcccgcaacgagcgcaacccttgtctttagttgccatcattaagttgggcactctagagagactgccagggataacctggaggaaggtggggatgacgtcaaatcatcatgccccttatgcttagggctacacacgtgctacaatgggtagtacagagggttgccaagccgtaaggtggagctaatcccttaaagctactctcagttcggattgtaggctgaaactcgcctacatgaagctggagttactagtaatcgcagatcagaatgctgcggtgaatgcgttcccgggtcttgtacacaccgcccgtcacaccacgggagttggagacgcccgaagccgattatctaaccttttggaagaagtcgtcgaaggtggaatcaataactggggtgaagtcgtaacaaggtagccgtatcggaaggtgcggctggatcacctcctttct

SEQ ID NO: 168 - DNA, 1501 bp, Artificial Sequence
  Clostridium_difficile
ttgagagtttgatcctggctcaggatgaacgctggcggcgtgcctaacacatgcaagttgagcgatttacttcggtaaagagcggcggacgggtgagtaacgcgtgggtaacctaccctgtacacacggataacataccgaaaggtatgctaatacgggataatatatttgagaggcatctcttaaatatcaaaggtgagccagtacaggatggacccgcgtctgattagctagttggtaaggtaacggcttaccaaggcgacgatcagtagccgacctgagagggtgatcggccacattggaactgagacacggtccaaactcctacgggaggcagcagtggggaatattgcacaatgggcgaaagcctgatgcagcaacgccgcgtgagtgatgaaggccttcgggtcgtaaaactctgtcctcaaggaagataatgacggtacttgaggaggaagccccggctaactacgtgccagcagccgcggtaatacgtagggggctagcgttatccggatttactgggcgtaaagggtgcgtaggcggtctttcaagtcaggagtgaaaggctacggctcaaccgtagtaagctcttgaaactgggagacttgagtgcaggagaggagagtggaattcctagtgtagcggtgaaatgcgtagatattaggaggaacaccagttgcgaaggcggctctctggactgtaactgacgctgaggcacgaaagcgtggggagcaaacaggattagataccctggtagtccacgctgtaaacgatgagtactaggtgtcgggggttacccccttcggtgccgcagctaacgcattaagtactccgcctgggaagtacgctcgcaagagtgaaactcaaaggaattgacggggacccgcacaagtagcggagcatgtggtttaattcgaagcaacgcgaagaaccttacctaagcttgacatcccaatgacatctccttaatcggagagttcccttcggggacattggtgacaggtggtgcatggttgtcgtcagctcgtgtcgtgagatgttgggttaagtcccgcaacgagcgcaacccttgtctttagttgccatcattaagttgggcactctagagagactgccagggataacctggaggaaggtggggatgacgtcaaatcatcatgccccttatgcttagggctacacacgtgctacaatgggtagtacagagggttgccaagccgtaaggtggagctaatcccttaaagctactctcagttcggattgtaggctgaaactcgcctacatgaagctggagttactagtaatcgcagatcagaatgctgcggtgaatgcgttcccgggtcttgtacacaccgcccgtcacaccacggaagttggagacgcccgaagccgattatctaaccttttggaagaagtcgtcgaaggtggaatcaataactggggtgaagtcgtaacaaggtagccgtatcggaaggtgcggctggatcacctcctttct

SEQ ID NO: 169 - DNA, 1462 bp, Artificial Sequence
  Clostridium_difficile
agtttgatcctggctcaggatgaacgctggcggcgtgcctaacacatgcaagttgagcgatttacttcggtaaagagcggcggacgggtgagtaacgcgtgggtaacctaccctgtacacacggataacataccgaaaggtatgctaatacgggataatatatttgagaggcatctcttgaatatcaaaggtgagccagtacaggatggacccgcgtctgattagctagttggtaaggtaacggcttaccaaggcgacgatcagtagccgacctgagagggtgatcggccacattggaactgagacacggtccaaactcctacgggaggcagcagtggggaatattgcacaatgggcgaaagcctgatgcagcaacgccgcgtgagtgatgaaggccttcgggtcgtaaaactctgtcctcaaggaagataatgacggtacttgaggaggaagccccggctaactacgtgccagcagccgcggtaatacgtagggggctagcgttatccggatttactgggcgtaaagggtgcgtaggcggtctttcaagtcaggagtgaaaggctacggctcaaccgtagtaagctcttgaaactgggagacttgagtgcaggagaggagagtggaattcctagtgtagcggtgaaatgcgtagatattaggaggaacaccagttgcgaaggcggctctctggactgtaactgacgctgaggcacgaaagcgtggggagcaaacaggattagataccctggtagtccacgctgtaaacgatgagtactaggtgtcgggggttacccccttcggtgccgcagctaacgcattaagtactccgcctgggaagtacgctcgcaagagtgaaactcaaaggaattgacggggacccgcacaagtagcggagcatgtggtttaattcgaagcaacgcgaagaaccttacctaagcttgacatcccaatgacatctccttaatcggagagttcccttcggggacattggtgacaggtggtgcatggttgtcgtcagctcgtgtcgtgagatgttgggttaagtcccgcaacgagcgcaacccttgtctttagttgccatcattaagttgggcactctagagagactgccagggataacctggaggaaggtggggatgacgtcaaatcatcatgccccttatgcttagggctacacacgtgctacaatgggtagtacagagggttgccaagccgtaaggtggagctaatcccttaaagctactctcagttcggattgtaggctgaaactcgcctacatgaagctggagttactagtaatcgcagatcagaatgctgcggtgaatgcgttcccgggtcttgtacacaccgcccgtcacaccacgggagttggagacgcccgaagccgattatctaaccttttggaagaagtcgtcgaaggtggaatcaataactggggtgaagtcgtaacaaggtaacc

SEQ ID NO: 170 - DNA, 1472 bp, Artificial Sequence
  Clostridium_disporicum
gctcaggacgaacgctggcggcgtgcctaacacatgcaagtcgagcgagttgattctcttcggagatgaagctagcggcggacgggtgagtaacacgtgggcaacctgcctcatagaggggaatagcctcccgaaagggagattaataccgcataagattgtagcttcgcatgaagtagcaattaaaggagcaatccgctatgagatgggcccgcggcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgacggccttcgggttgtaaagctctgtcttcagggacgataatgacggtacctgaggaggaagccacggctaactacgtgccagcagccgcggtaatacgtaggtggcgagcgttgtccggatttactgggcgtaaagggagcgtaggcggacttttaagtgagatgtgaaatacccgggctcaacttgggtgctgcatttcaaactggaagtctagagtgcaggagaggagaatggaattcctagtgtagcggtgaaatgcgtagagattaggaagaacaccagtggcgaaggcgattctctggactgtaactgacgctgaggctcgaaagcgtggggagcaaacaggattagataccctggtagtccacgccgtaaacgatgaatactaggtgtaggggttgtcatgacctctgtgccgccgctaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgaattacccgtaactggggaagccacttcggtggcaggaagacaggtggtgcatggttgtcgtcagctcgtgtcgtgagatgttgggttaagtcccgcaacgagcgcaacccttattgttagttgctaccatttagttgagcactctagcgagactgcccgggttaaccgggaggaaggtggggatgacgtcaaatcatcatgccccttatgtctagggctacacacgtgctacaatggcaagtacaaagagaagcaagaccgcgaggtggagcaaaactcaaaaacttgtctcagttcggattgtaggctgaaactcgcctacatgaagctggagttgctagtaatcgcgaatcagcatgtcgcggtgaatacgttcccgggccttgtacacaccgcccgtcacaccatgagagttggcaatacccaacgtacgtgatctaacccgcaagggaggaagcgtcctaaggtagggtcagcgattggggtgaagtcgtaacaaggtagccgtaggagaa

SEQ ID NO: 171 - DNA, 1266 bp, Artificial Sequence
  Clostridium_disporicum
catgcaagtcgagcgagcggcggacgggtgagtaacacgtgggcaacctgcctcatagaggggaatagcctcccgaaagggagattaataccgcataagtaaagccgctatgagatgggcccgcggcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgacggccttcgggttgtaaagctctgtcttcagggacgatgacggtacctgaggaggaagccacggctaactacgtgccagcagccgcggtaatacgtaggtggcgagcgttgtccggatttactgggcgtaaagggagcgtaggcggacttttaagtgagatgtgaaatacccgggctcaacttgggtgctgcatttcaaactggaagtctagagtgcaggagaggagaatggaattcctagtgtagcggtgaaatgcgtagagattaggaagaacaccagtggcgaaggcgattctctggactgactgacgctgaggctcgaaagcgtggggagcaaacaggattagataccctggtagtccacgccgtaaacgatgaatactaggtgtaggggcctctgtgccgccgctaacgcattaagtattccgcctggggagtacggtcgcaagattaaaactcaaaggaattgacgggggcccgcacaagcagcggagcatgtggtttaattcgaagcaacgcgaagaaccttacctagacttgacatcgacaggtggtgcatggttgtcgtcagctcgtgtcgtgagatgttgggttaagtcccgcaacgagcgcaacccttattgttagttgctaccatgagcactctagcgagactgcccgggttaaccgggaggaaggtggggatgacgtcaaatcatcatgccccttatgtctagggctacacacgtgctacaatggcaagcaaagagaagcaagaccgcgaggtggagcaaaactcacttgtctcagttcggatgtaggctgaaactcgcctacagaagctggagttgctagtaatcgcgaatcagcatgtcgcggtgaatacgttcccgggccttgtacacaccgcccgtcacaccatgagagttggcaatacccaacgtacgtatctaggaagcgtcctaaggtagggtcagcgattgggg

SEQ ID NO: 172 - DNA, 1463 bp, Artificial Sequence
  Clostridium_ghonii
agagtttgatcctggctcaggatgaacgctggcggcgtgcctaacacatgcaagtcgagcgattccttcgggaagagcggcggacgggtgagtaacgcgtgggtaacctgccctgtacacacggataacataccgaaaggtatgctaatacgggataaaatatgaaagttgcataactttcatatcaaagcttttgcggtacaggatggacccgcgtctgattagctagttggtaaggtaacggcttaccaaggcaacgatcagtagccgacctgagagggtgatcggccacactggaactgagacacggtccagactcctacgggaggcagcagtggggaatattgcacaatgggcgaaagcctgatgcagcaacgccgcgtgagcgatgaaggccttcgggtcgtaaagctctgtcctcaaggaagataatgacggtacttgaggaggaagccccggctaactacgtgccagcagccgcggtaatacgtagggggctagcgttatccggaattactgggcgtaaagggtgcgtaggcggtctttcaagccagaagtgaaaggctacggctcaaccgtagtaagcttttggaactgtaggacttgagtgcaggagaggagagtggaattcctagtgtagcggtgaaatgcgtagatattaggaggaacaccagtagcgaaggcggctctctggactgtaactgacgctgaggcacgaaagcgtggggagcgaacaggattagataccctggtagtccacgccgtaaacgatgagtactaggtgtcgggggttacccccctcggtgccgcagctaacgcattaagtactccgcctgggaagtacgctcgcaagagtgaaactcaaaggaattgacggggacccgcacaagtagcggagcatgtggtttaattcgaagcaacgcgaagaaccttacctaagcttgacatcccattgacctctccctaatcggagatttcccttcggggacagtggagacaggtggtgcatggttgtcgtcagctcgtgtcgtgagatgttgggttaagtcccgcaacgagcgcaacccttgcctttagttgccagcattaagttgggcactctagagggactgccgaggataactcggaggaaggtggggatgacgtcaaatcatcatgccccttatgcttagggctacacacgtgctacaatgggtggtacagagggttgccaagccgcgaggtggagctaatcccttaaagccattctcagttcggattgtaggctgaaactcgcctacatgaagctggagttactagtaatcgcagatcagaatgctgcggtgaatgcgttcccgggtcttgtacacaccgcccgtcacaccatgggagttgggggcgcccgaagccggttagctaaccttttaggaagcggccgtcgaaggtgaaaccaatgactggggtgaagtcgtaacaaggtaacc

SEQ ID NO: 173 - DNA, 1409 bp, Artificial Sequence
  Clostridium_glycolicum
ctggcggcgtgcctaacacatgcaagtcgagcgattcacttcggtgaagagcggcggacgggtgagtaacgcgtgggtaacctgcctcatacacatggataacataccgaaaggtatgctaatacaggataayataagaaattcacatgtatttcttatcaaagctccggcggtatgagatggacccgcgtctgattagctagttggtaaggtaacggcttaccaaggcgacgatcagtagccgacctgagagggtgatcggccacattggaactgagacacggtccaaactcctacgggaggcagcagtggggaatattgcacaatgggcgaaagcctgatgcagcaacgccgcgtgagtgatgaaggccttcgggtcgtaaaactctgtcctcaaggaagataatgacggtacttgaggaggaagccccggctaactacgtgccagcagccgcggtaatacgtagggggctagcgttatccggatttactgggcgtaaagggtgcgtaggtggtttcttaagtcaggagtgaaaggctacggctcaaccgtagtaagctcttgaaactgggagacttgagtgcaggagaggaaagtggaattcctagtgtagcggtgaaatgcgtagatattaggaggaacaccagtagcgaaggcggctttctggactgtaactgacactgaggcacgaaagcgtggggagcgaacaggattagataccctggtagtccacgccgtaaacgatgagtactaggtgtcgggggttacccccctcggtgccgcagctaacgcattaagtactccgcctggggagtacgctcgcaagagtgaaactcaaaggaattgacggggacccgcacaagtagcggagcatgtggtttaattcgaagcaacgcgaagaaccttacctaagcttgacatccttttgaccgatgcctaatcgcatttttcccttcggggacagaagtgacaggtggtgcatggttgtcgtcagctcgtgtcgtgagatgttgggttaagtcccgcaacgagcgcaacccttgcctttagttgccagcattaagttgggcactctagagggactgccagggataacctggaggaaggtggggatgacgtcaaatcatcatgccccttatgcttagggctacacacgtgctacaatgggtggtacagagggcagccaagtcgtgaggccgagctaatcccttaaagccattctcagttcggattgtaggctgaaactcgcctacatgaagctggagttactagtaatcgcagatcagaatgctgcggtgaatgcgttcccgggtcttgtacacaccgcccgtcacaccacggaagttgggggcgcccgaagccacttagctaacccttttgggaagcgagtgtcgaaggtgaaatcaat

SEQ ID NO: 174 - DNA, 1389 bp, Artificial Sequence
  Clostridium_glycyrrhizinilyticum
tagagtttgatcctggctcaggatgaacgctggcggcgtgcttaacacatgcaagtcgaacgaagcactttaccggatttcttcgggatgaaagttttgtgactgagtggcggacgggtgagtaacgcgtgggtaacctgcctcatacagggggataacagttagaaatgactgctaataccgcataagaccacaggattgcatgatccggtggtaaaaactccggtggtatgagatggacccgcgtctgattaggtagttggtggggtaacggctcaccaagccgacgatcagtagccgacctgagagggtgaccggccacattgggactgagacacggcccaaactcctacgggaggcagcagtggggaatattgcacaatgggggaaaccctgatgcagcgacgccgcgtgagcgatgaagtatttcggtatgtaaagctctatcagcagggaagaaaatgacggtacctgactaagaagcaccggctaaatacgtgccagcagccgcggtaatacgtatggtgcaagcgttatccggatttactgggtgtaaagggagcgtagacggagaggcaagtctgatgtgaaaacccggggctcaaccccgggattgcattggaaactgcttttctagagtgtcggagaggtaagtggaattcctagtgtagcggtgaaatgcgtagatattaggaggaacaccagtggcgaaggcggcttactggacgatgactgacgttgaggctcgaaagcgtggggagcaaacaggattagataccctggtagtccacgccgtaaacgatgactgctaggtgtcggggggcaaagcctttcgtgccgcagcaaacgcaataagcagtccccctggggagtacgttcgcaagaatgaaactcaaaggaattgacggggacccgcacaagcggtggagcatgtggtttaattcgaagcaacgcgaagaaccttacctgcccttgacatccggctgaccggcgagtaatgtcgcctttccttcgggacagccgagacaggtggtgcatggttgtcgtcagctcgtgtcgtgagatgttgggttaagtcccgcaacgagcgcaacccttatctttagtagccagcatttcggatgggcactctagagagactgccagggataacctggaggaaggtggggatgacgtcaaatcatcatgccccttatgggcagggctacacacgtgctacaatggcgtaaacaaagggaggcaagcctgcgagggtgagcaaatcccaaaaataacgtctcagttcggattgtagtctgcaactcgactacatgaagcaggaatcgctagtaatcgcgaatcagaatgtcgcggtgaatacgttcccgggtcttgtacacaccgcccgtc

SEQ ID NO: 175 - DNA, 1393 bp, Artificial Sequence
  Clostridium_hiranonis
acatgcaagtcgagcgattctcttcggagaagagcggcggacgggtgagtaacgcgtgggtaacctgccctgtacacacggataacataccgaaaggtatgctaatacgggataatatataagagtcgcatgacttttatatcaaagatttttcggtacaggatggacccgcgtctgattagcttgttggcggggtaacggcccaccaaggcgacgatcagtagccgacctgagagggtgatcggccacattggaactgagacacggtccaaactcctacgggaggcagcagtggggaatattgcacaatgggcgcaagcctgatgcagcaacgccgcgtgagcgatgaaggccttcgggtcgtaaagctctgtcctcaaggaagataatgacggtacttgaggaggaagccccggctaactacgtgccagcagccgcggtaatacgtagggggctagcgttatccggatttactgggcgtaaagggtgcgtaggcggtctttcaagtcaggagttaaaggctacggctcaaccgtagtaagctcctgatactgtctgacttgagtgcaggagaggaaagcggaattcccagtgtagcggtgaaatgcgtagatattgggaggaacaccagtagcgaaggcggctttctggactgtaactgacgctgaggcacgaaagcgtggggagcaaacaggattagataccctggtagtccacgctgtaaacgatgagtactagttgtcggaggttaccccttcggtgccgcagctaacgcattaagtactccgcctggggagtacgcacgcaagtgtgaaactcaaaggaattgacggggacccgcacaagtagcggagcatgtggtttaattcgaagcaacgcgaagaaccttacctaggcttgacatccttctgaccgaggactaatctcctctttccctccggggacagaagtgacaggtggtgcatggttgtcgtcagctcgtgtcgtgagatgttgggttaagtcccgcaacgagcgcaacccttgtctttagttgccatcattaagttgggcactctagagagactgccagggataacctggaggaaggtggggatgacgtcaaatcatcatgccccttatgcctagggctacacacgtgctacaatgggtggtacagagggcagccaagccgtgaggtggagcaaatcccttaaagccattctcagttcggattgtaggctgaaactcgcctacatgaagctggagttactagtaatcgcagatcagaatgctgcggtgaatgcgttcccgggtcttgtacacaccgcccgtcacaccatgggagttggagacacccgaagccgactatctaaccttttgggagaagtcgtccccctcgaatcaatacccc

SEQ ID NO: 176 - DNA, 1272 bp, Artificial Sequence
  Clostridium_hylemonae
agtggcggacgggtgagtaacgcgtgggcaacctgccttacacagggggataacagctagaaatggctgctaataccgcataagaaaaagtggtgtaagatgggcccgcgtctgattaggtagttggtagggtaacggcctaccaagccgacgatcagtagccgacctgagagggtgaccggccacattgggactgagacacggcccaaactcctacgggaggcagcagtggggaatattgcacaatgggggaaaccctgatgcagcgacgccgcgtgaaggatgaagtatttcggtatgtaaacttctatcagcagggaagatgacggtacctgactaagaagccccggctaactacgtgccagcagccgcggtaatacgtagggggcaagcgttatccggatttactgggtgtaaagggagcgtagacggcatggcaagtctgaagtgaaagcccggggctcaaccccgggactgctttggaaactgtcaggctagagtgtcggagaggcaagtggaattcctagtgtagcggtgaaatgcgtagatattaggaggaacaccagtggcgaaggcggcttgctggacgaactgacgttgaggctcgaaagcgtggggagcaaacaggattagataccctggtagtccacgccgtaaacgatgattactaggtgtcgggatttcggtgccgcagccaacgcaataagtaatccacctggggagtacgttcgcaagaatgaaactcaaaggaattgacggggacccgcacaagcggtggagcatgtggtttaattcgaagcaacgcgaagaaccttacctgatcttgacatcgacaggtggtgcatggttgtcgtcagctcgtgtcgtgagatgttgggttaagtcccgcaacgagcgcaacccttatctttagtagccagcatgtgggcactctagagagactgccagggataacctggaggaaggtggggatgacgtcaaatcatcatgccccttatgaccagggctacacacgtgctacaatggcgtacaaagggaagcgaccctgtgaaggcaagcaaatcccaaaacgtctcagttcggatgtagtctgcaactcgactacagaagctggaatcgctagtaatcgcgaatcagaatgtcgcggtgaatacgttcccgggtcttgtacacaccgcccgtcacaccatgggagtcagtaacgcccgaagccggtacctaaggagccgtcgaaggtgggaccgataactggggtgaagtcgtaacaaggta

SEQ ID NO: 177 - DNA, 1445 bp, Artificial Sequence
  Clostridium_hylemonae
aggatgaacgctgccgccgtgcttaacacatgcaagtcgaacgaagcaatactgtgtgaagagattagcttgctaagatcagaactttgtattgactgagtggcggacgggtgagtaacgcgtgggcaacctgccttacacagggggataacagctagaaatggctgctaataccgcataagacctcagtaccgcatggtagaggggtaaaaactccggtggtgtaagatgggcccgcgtctgattaggtagttggtagggtaacggcctaccaagccgacgatcagtagccgacctgagagggtgaccggccacattggactgagacacggcccaaactcctacgggaggcagcagtggggaatattgcacaatgggggaaaccctgatgcagcgacgccgcgtgaaggatgaagtatttcggtatgtaaacttctatcagcagggaagaagatgacggtacctgactaagaagccccggctaactacgtgccagcagccgcggtaatacgtagggggcaagcgttatccggatttactgggtgtaaagggagcgtagacggcatggcaagtctgaagtgaaagcccggggctcaaccccgggactgctttggaaactgtcaggctagagtgtcggagaggcaagtggaattcctagtgtagcggtgaaatgcgtagatattaggaggaacaccagtggcgaagcggcttgctggacgatgactgacgttgaggctcgaaagcgtggggagcaaacaggattagataccctggtagtccacgccgtaaacgatgattactaggtgtcgggaagcaaagcttttcggtgccgcagccaacgcaataagtaatccacctggggagtacgttcgcaagaatgaaactcaaaggaattgacggggacccgcacaagcggtggagcatgtggtttaattcgaagcaacgcgaagaaccttacctgatcttgacatcccggtgacaaagtatgtaacgtactctttcttcggaacaccggtgacaggtggtgcatggttgtcgtcagctcgtgtcgtgagatgttgggttaagtcccgcaacggcgcaacccttatctttagtagccagcatttgaggtgggcactctagagagactgccagggataacctggaggaaggtggggatgacgtcaaatcatcatgccccttatgaccagggctacacacgtgctacaatggcgtaaacaaagggaagcgaccctgtgaaggcaagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatggggtcagtaacgcccgaagccggtgacctaaccgcaaaggaggagccgtcgaaggtg

SEQ ID NO: 178 - DNA, 1298 bp, Artificial Sequence
  Clostridium_hylemonae
ctttgtattgactgagtggcggacgggtgagtaacgcgtgggcaacctgccttacacagggggataacagctagaaatggctgctaataccgcataagacctcagtaccgcatggtagaggggtaaaaactccggtggtgtaagatgggcccgcgtctgattaggtagttggtagggtaacggcctaccaagccgacgatcagtagccgacctgagagggtgaccggccacattggactgagaaacggcccaaactcctacgggaggcagcagtggggaatattgcacaatgggggaaaccctgatgcagcgacgccgcgtgaaggatgaagtatttcggtatgtaaacttctatcagcagggaagaagatgacggtacctgactaagaagccccggctaactacgtgccagcagccgcggtaatacgtagggggcaagcgttatccggatttactgggtgtaaagggagcgtagacggcatggcaagtctgaagtgaaagcccggggctcaaccccgggactgctttggaaactgtcaggctagagtgtcggagaggcaagtggaattcctagtgtagcggtgaaatgcgtagatattaggaggaacaccagtggcgaaggcggcttgctggacgatgactgacgttgaggctcgaaaccgtggggagcaaacaggattagataccctggtagtccacgccgtaaacgatgattactaggtgtcgggaagcaaagcttttcggtgccgcagccaacgcaataagtaatccacctggggagtacgttcgcaagaatgaaactcaaaggaattgacggggacccgcacaagcggtggagcatgtggtttaattcgaagcaacgcgaagaaccttacctgatcttgacatcccggtgacaaagtatgtaacgtactctttcttcggaacaccggtgacaggtggtgcatggttgtcgtcagctcgtgtcgtgagatgttgggttaagtcccgcaacgggcgcaacccttatctttagtagccagcatttgaggtgggcactctagagagactgccagggataacctggaggaaggtggggatgacgtcaaatcatcatgccccttatgaccagggctacacacgtgctacaatggcgtaaacaaagggaagcgaccctgtgaaggcaagcaaatcccaaaaataacgtctcagttcggattgtagtctgcaactcgactacatgaagctggaatcgctagtaatcgcgaatcagaatgtcgcggtgaatacggttcccgggtcttgtacacaccgcccgt

SEQ ID NO: 179 - DNA, 1475 bp, Artificial Sequence
  Clostridium_innocuum
  misc_feature (905)..(905): n is a, c, g, or t
  misc_feature (942)..(942): n is a, c, g, or t
atggagagtttgatcctggctcaggatgaacgctggcggcatgcctaatacatgcaagtcgaacgaagtcttcaggaagcttgcttccaaaaagacttagtggcgaacgggtgagtaacacgtaggtaacctgcccatgtgtccgggataactgctggaaacggtagctaaaaccggataggtatacggagcgcatgctctgtatattaaagcgcccttcaaggcgtgaacatggatggacctgcgacgcattagctagttggtgaggtaacggcccaccaaggcgatgatgcgtagccggcctgagagggtaaacggccacattgggactgagacacggcccaaactcctacgggaggcagcagtagggaattttcgtcaatgggggaaaccctgaacgagcaatgccgcgtgagtgaagaaggtcttcggatcgtaaagctctgttgtaagtgaagaacggctcatagaggaaatgctatgggagtgacggtagcttaccagaaagccacggctaactacgtgccagyagccgcggtaatacgtaggtggcaagcgttatccggaatcattgggcgtaaagggtgcgtaggtggcgtactaagtctgtagtaaaaggcaatggctcaaccattgtaagctatggaaactggtatgctggagtgcagaagagggcgatggaattccatgtgtagcggtaaaatgcgtagatatatggaggaacaccagtggcgaaggcggtcgcctggtctgtaactgacactgaggcacgaaagcgtggggagcaaataggattagataccctagtagtccacgccgtaaacgatgagaactaagtgttggagaaattcagtgctgcagttaacgcaataagttctccgcctggggagtatgcacgcaagttngaaactcaaaggaattgacgggggcccgcacaagcgntggagtatgtggtttaattcgaagcaacgcgaagaaccttaccaggccttgacatggaaacaaataccctagagatagggggataattatggatcacacaggtggtgcatggttgtcgtcagctcgtgtcgtgagatgttgggttaagtcccgcaacgagcgcaacccttgtcgcatgttaccagcatcaagttggggactcatgcgagactgccggtgacaaaccggaggaaggtggggatgacgtcaaatcatcatgccccttatggcctgggctacacacgtactacaatggcgaccacaaagagcagcgacttggtgacaagaagcgaatctcataaagatcgtctcagttcggattgaagtctgcaactcgacttcatgaagtcggaatcgctagtaatcgcagatcagcatgctgcggtgaatacgttctcgggccttgtacacaccgcccgtcaaaccatgggagtcagtaatacccgaagccggtggcataaccgtaaggagtgagccgtcgaaggtaggaccga

SEQ ID NO: 180 - DNA, 1480 bp, Artificial Sequence
  Clostridium_innocuum
  misc_feature (1)..(1): n is a, c, g, or t
  misc_feature (4)..(5): n is a, c, g, or t
  misc_feature (910)..(910): n is a, c, g, or t
  misc_feature (947)..(947): n is a, c, g, or t
ncannatggagagtttgatcctggctcaggatgaacgctggcggcatgcctaatacatgcaagtcgaacgaagtcttcaggaagcttgcttccaaaaagacttagtggcgaacgggtgagtaacacgtaggtaacctgcccatgtgtccgggataactgctggaaacggtagctaaaaccggataggtatacggagcgcatgctctgtatattaaagcgcccttcaaggcgtgaacatggatggacctgcgacgcattagctagttggtgaggtaacggcccaccaaggcgatgatgcgtagccggcctgagagggtaaacggccacattgggactgagacacggcccaaactcctacgggaggcagcagtagggaattttcgtcaatgggggaaaccctgaacgagcaatgccgcgtgagtgaagaaggtcttcggatcgtaaagctctgttgtaagtgaagaacggctcatagaggaaatgctatgggagtgacggtagcttaccagaaagccacggctaactacgtgccagyagccgcggtaatacgtaggtggcaagcgttatccggaatcattgggcgtaaagggtgcgtaggtggcgtactaagtctgtagtaaaaggcaatggctcaaccattgtaagctatggaaactggtatgctggagtgcagaagagggcgatggaattccatgtgtagcggtaaaatgcgtagatatatggaggaacaccagtggcgaaggcggtcgcctggtctgtaactgacactgaggcacgaaagcgtggggagcaaataggattagataccctagtagtccacgccgtaaacgatgagaactaagtgttggagaaattcagtgctgcagttaacgcaataagttctccgcctggggagtatgcacgcaagttngaaactcaaaggaattgacgggggcccgcacaagcgntggagtatgtggtttaattcgaagcaacgcgaagaaccttaccaggccttgacatggaaacaaataccctagagatagggggataattatggatcacacaggtggtgcatggttgtcgtcagctcgtgtcgtgagatgttgggttaagtcccgcaacgagcgcaacccttgtcgcatgttaccagcatcaagttggggactcatgcgagactgccggtgacaaaccggaggaaggtggggatgacgtcaaatcatcatgccccttatggcctgggctacacacgtactacaatggcgaccacaaagagcagcgacttggtgacaagaagcgaatctcataaagatcgtctcagttcggattgaagtctgcaactcgacttcatgaagtcggaatcgctagtaatcgcagatcagcatgctgcggtgaatacgttctcgggccttgtacacaccgcccgtcaaaccatgggagtcagtaatacccgaagccggtggcataaccgtaaggagtgagccgtcgaaggtaggaccga

SEQ ID NO: 181 - DNA, 1475 bp, Artificial Sequence
  Clostridium_innocuum
ctggctcaggatgaacgctggcggcatgcctaatacatgcaagtcgaacgaagtttcgaggaagcttgcttccaaagagacttagtggcgaacgggtgagtaacacgtaggtaacctgcccatgtgtccgggataactgctggaaacggtagctaaaaccggataggtatacagagcgcatgctcagtatattaaagcgcccatcaaggcgtgaacatggatggacctgcggcgcattagctagttggtgaggtaacggcccaccaaggcgatgatgcgtagccggcctgagagggtaaacggccacattgggactgagacacggcccaaactcctacgggaggcagcagtagggaattttcgtcaatgggggaaaccctgaacgagcaatgccgcgtgagtgaagaaggtcttcggatcgtaaagctctgttgtaagtgaagaacggctcatagaggaaatgctatgggagtgacggtagcttaccagaaagccacggctaactacgtgccagcagccgcggtaatacgtaggtggcaagcgttatccggaatcattgggcgtaaagggtgcgtaggtggcgtactaagtctgtagtaaaaggcaatggctcaaccattgtaagctatggaaactggtatgctggagtgcagaagagggcgatggaattccatgtgtagcggtaaaatgcgtagatatatggaggaacaccagtggcgaaggcggtcgcctggtctgtaactgacactgaggcacgaaagcgtggggagcaaataggattagataccctagtagtccacgccgtaaacgatgagaactaagtgttggaggaattcagtgctgcagttaacgcaataagttctccgcctggggagtatgcacgcaagtgtgaaactcaaaggaattgacgggggcccgcacaagcggtggagtatgtggtttaattcgaagcaacgcgaagaaccttaccaggccttgacatggaaacaaataccctagagatagggggataattatggatcacacaggtggtgcatggttgtcgtcagctcgtgtcgtgagatgttgggttaagtcccgcaacgagcgcaacccttgtcgcatgttaccagcatcaagttggggactcatgcgagactgccggtgacaaaccggaggaaggtggggatgacgtcaaatcatcatgccccttatggcctgggctacacacgtactacaatggcgrccacaaagagcagcgacacagtgatgtgaagcgaatctcataaaggtcgtctcagttcggattgaagtctgcaactcgacttcatgaagtcggaatcgctagtaatcgcagatcagcatgctgcggtgaatacgttctcgggccttgtacacaccgcccgtcaaaccatgggagtcagtaatacccgaagccggtggcataaccgtaaggagtgagccgtcgaaggtaggaccgatgactggggttaagt

SEQ ID NO: 182 - DNA, 1444 bp, Artificial Sequence
  Clostridium_innocuum
agacttagtggcgaacgggtgagtaacacgtaggtaacctgcccatgtgtccgggataactgctggaaacggtagctaaaaccggataggtatacggagcgcatgctctgtatattaaagcgcccatcaaggcgtgaacatggatggacctgcggcgcattagctagttggtgaggtaacggcccaccaaggcgatgatgcgtagccggcctgagagggtaaacggccacattgggactgagacacggcccaaactcctacgggaggcagcagtagggaattttcgtcaatgggggaaaccctgaacgagcaatgccgcgtgagtgaagaaggtcttcggatcgtaaagctctgttgtaagtgaagaacggctcatagaggaaatgctatgggagtgacggtagcttaccagaaagccacggctaactacgtgccagcagccgcggtaatacgtaggtggcaagcgttatccggaatcattgggcgtaaagggtgcgtaggtggcgtactaagtctgtagtaaaaggcaatggctcaaccattgtaagctatggaaactggtatgctggagtgcagaagagggcgatggaattccatgtgtagcggtaaaatgcgtagatatatggaggaacaccagtggcgaaggcggtcgcctggtctgtaactgacactgaggcacgaaagcgtggggagcaaataggattagataccctagtagtccacgccgtaaacgatgagaactaagtgttggaggaattcagtgctgcagttaacgcaataagttctccgcctggggagtatgcacgcaagtgtgaaactcaaaggaattgacgggggcccgcacaagcggtggagtatgtggtttaattcgaagcaacgcgaagaaccttaccaggccttgacatggaaacaaataccctagagatagggggataattatggatcacacaggtggtgcatggttgtcgtcagctcgtgtcgtgagatgttgggttaagtcccgcaacgagcgcaacccttgtcgcatgttaccagcatcaagttggggactcatgcgagactgccggtgacaaaccggaggaaggtggggatgacgtcaaatcatcatgccccttatggcctgggctacacacgtactacaatggcgaccacaaagagcagcgacacagtgatgtgaagcgaatctcataaaggtcgtctcagttcggattgaagtctgcaactcgacttcatgaagtcggaatcgctagtaatcgcagatcagcatgctgcggtgaatacgttctcgggccttgtacacaccgcccgtcaaaccatgggagtcagtaatacccgaagccggtggcataaccgtaaggagtgagccgtcgaaggtaggaccgatgactggggttaagtcgtaacaaggtatccctacgggaacgtggggatggatcacctcctt

SEQ ID NO: 183 - DNA, 1489 bp, Artificial Sequence
  Clostridium_irregulare
gagagtttgatcctggctcaggatgaacgctggcggcgtgcctaacacatgcaagtcgagcgaacttcggggtgagcggcggacgggtgagtaacgcgtgggtaacctgcctcatacacatgggataacataccgaaaggtatgctaatacaggataacatagtttttatcgcatgataaaaatatcaaagctccggcggtatgagatggacccgcgtctgattagctagttggtaaggtaatggcttaccaaggcgacgatcagtagccgacctgagagggtgatcggccacattggaactgagacacggtccaaactcctacgggaggcagcagtggggaatattgcacaatgggcgaaagcctgatgcagcaacgccgcgtgagcgatgaaggccttcgggtcgtaaagctctgtcctcaaggaagataatgacggtacttgaggaggaagccccggctaactacgtgccagcagccgcggtaatacgtagggggctagcgttatccggatttactgggcgtaaagggtgcgtaggcggtctttcaagtcaggagtgaaaggctacggctcaaccgtagtaagctcttgaaactgggagacttgagtgcaggagaggagagtggaattcctagtgtagcggtgaaatgcgtagatattaggaggaacaccagtagcgaaggcgctctctggactgtaactgacgctgaggcacgaaagcgtggggagcgaacaggattagataccctggtagtccacgccgtaaacgatgagtactaggtgtcgggggttaccccctcggtgccgcagctaacgcattaagtactccgcctggggagtacgctcgcaagagtgaaactcaaaggaattgacggggacccgcacaagtagcggagcatgtggtttaattcgaagcaacgcgaagaaccttacctaagcttgacatccttctgactctccttaatcggagatttccttcggggacagaagtgacaggtggtgcatggttgtcgtcagctcgtgtcgtgagatgttgggttaagtcccgcaacgagcgcaacccttgcctttagttgccagcattaagttgggcactctagagggactgccagggtaacctggaggaaggtggggatgacgtcaaatcatcatgccccttatgcttagggctacacacgtgctacaatgggtggtacagagggcagccaagtcgtgaggcggagctaatcccttaaagccattctcagttcggattgtaggctgaaactcgcctacatgaagctggagttactagtaatcgcagatcagaatgctgcggtgaatgcgttcccgggtcttgtacacaccgcccgtcacaccacgggagttggagacgcccgaagcggactatctaaccttttggaagaagtcgtcgaaggtggaatcaataactggggtgaagtcgtaacaaggtagccgtaggagaacctgcggctggatcacctcctt

SEQ ID NO: 184 - DNA, 1454 bp, Artificial Sequence
  Clostridium_lavalense
gatgaacgctggcggcgtgcctaacacatgcaagtcgaacgaagcattttraatgaagttttcggatggattytgagatgactgagtggcggacgggtgagtaacacgtggataacctgcctcacactgggggacaacagttagaaatgactgctaataccgcataagcgcacagtaccgcatggtacagtgtgaaaaactccggtggtgtgagatggatccgcgtctgattagccagttggcggggtaacggcccaccaaagcgacgatcagtagccgacctgagagggtgaccggccacattgggactgagacacggcccaaactcctacgggaggcagcagtggggaatattgcacaatgggcgaaagcctgatgcagcgacgccgcgtgagtgaagaagtatttcggtatgtaaagctctatcagcagggaagataatgacggtacctgactaagaagccccggctaactacgtgccagcagccgcggtaatacgtagggggcaagcgttatccggatttactgggtgtaaagggagcgtagacggcatggcaagtctgaagtgaaaacccagggctcaaccctgggactgctttggaaactgtcaagctagagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgagtgctaggtgttggggggcaaagcccttcggtgccgtcgcaaacgcaataagcactccacctggggagtacgttcgcaagaatgaaactcaaaggaattgacggggacccgcacaagcggtggagcatgtggtttaattcgaagcaacgcgaagaaccttaccaagtcttgacatcctcttgaccggcgtgtaacggcgcctttccttcgggacaagrgagacaggtggtgcatggttgtcgtcagctcgtgtcgtgagatgttgggttaagtcccgcaacgagcgcaacccttatccttagtagccagcartragatgggcactctagggagactgccagggacaacctggaggaaggtggggatgacgtcaaatcatcatgccccttatgatttgggctacacacgtgctacaatggcgtaaacaaagggaagcgaccctgcgaaggtgagcaaatctcaaaaataacgtcccagttcggactgtagtctgcaacccgactacacgaagctggaatcgctagtaatcgcgaatcagaatgtcgcggtgaatacgttcccgggtcttgtacacaccgcccgtcacaccatgggagtcagcaacgcccgaagtcagtgacccaactcgcargagagggakctgccgaasgcggcgcakgtaactggggtg

SEQ ID NO: 185 - DNA, 1494 bp, Artificial Sequence
  Clostridium_mayombei
gagtttgatcctggctcaggatgaacgctggcggcgtgcctaacacatgcaagtcgagcgattctcttcggagaagagcggcggacgggtgagtaacgcgtgggtaacctgcctcatacacatggataacataccgaaaggtatgctaatacaggatgatataagagattcacatggatttcttatcaaagctccggcggtatgagatggacccgcgtctgattagctagttggtaaggtaatggcttaccaaggcgacgatcagtagccgacctgagagggtgatcggccacattggaactgagacacggtccaaactcctacgggaggcagcagtggggaatattgcacaatgggcgaaagcctgatgcagcaacgccgcgtgagtgatgaaggccttcgggtcgtaaaactctgtcctcaaggaagataatgacggtacttgaggaggaagccccggctaactacgtgccagcagccgcggtaatacgtagggggctagcgttatccggatttactgggcgtaaagggtgcgtaggtggtttcttaagtcaggagtgaaaggctacggctcaaccgtagtaagctcttgaaactgggagacttgagtgcaggagaggaaagtggaattcctagtgtagcggtgaaatgcgtagatattaggaggaacaccagtagcgaaggcggctttctggactgtaactgacactgaggcacgaaagcgtggggagcgaacaggattagataccctggtagtccacgccgtaaacgatgagtactaggtgtcgggggttacccccctcggtgccgcagctaacgcattaagtactccgcctggggagtacgctcgcaagagtgaaactcaaaggaattgacggggacccgcacaagtagcggagcatgtggtttaattcgaagcaacgcgaagaaccttacctaagcttgacatccttttgaccgatgcctaatcgcatctttcccttcggggacagaagtgacaggtggtgcatggttgtcgtcagctcgtgtcgtgagatgttgggttaagtcccgcaacgagcgcaacccttgcctttagttgccagcattaagttgggcactctagagggactgccagggataacctggaggaaggtggggatgacgtcaaatcatcatgccccttatgcttagggctacacacgtgctacaatgggtggtacagagggcagccaagtcgtgaggccgagctaatcccttaaagccattctcagttcggattgtaggctgaaactcgcctacatgaagctggagttactagtaatcgcagatcagaatgctgcggtgaatgcgttcccgggtcttgtacacaccgcccgtcacaccacggaagttgggggcgcccgaagccacttagctaaccttttggaagcgagtgtcgaaggtgaaatcaataactggggtgaagtcgtaacaaggtagccgtatcggaaggtgcggctggatcacctcctt

SEQ ID NO: 186 - DNA, 1500 bp, Artificial Sequence
  Clostridium_orbiscindens
ggctcaggatgaacgctggcggcgtgcttaacacatgcaagtcgaacggggtgctcatgacggaggattcgtccaacggattgagttacctagtggcggacgggtgagtaacgcgtgaggaacctgccttggagaggggaataacactccgaaaggagtgctaataccgcatgatgcagttgggtcgcatggctctgactgccaaagatttatcgctctgagatggcctcgcgtctgattagctagtaggcggggtaacggcccacctaggcgacgatcagtagccggactgagaggttgaccggccacattgggactgagacacggcccagactcctacgggaggcagcagtggggaatattgggcaatgggcgcaagcctgacccagcaacgccgcgtgaaggaagaaggctttcgggttgtaaacttcttttgtcggggacgaaacaaatgacggtacccgacgaataagccacggctaactacgtgccagcagccgcggtaatacgtaggtggcaagcgttatccggatttactgggtgtaaagggcgtgtaggcgggattgcaagtcagatgtgaaaactgggggctcaacctccagcctgcatttgaaactgtagttcttgagtgctggagaggcaatcggaattccgtgtgtagcggtgaaatgcgtagatatacggaggaacaccagtggcgaaggcggattgctggacagtaactgacgctgaggcgcgaaagcgtggggagcaaacaggattagataccctggtagtccacgccgtaaacgatggatactaggtgtggggggtctgaccccctccgtgccgcagttaacacaataagtatcccacctggggagtacgatcgcaaggttgaaactcaaaggaattgacgggggcccgcacaagcggtggagtatgtggtttaattcgaagcaacgcgaagaaccttaccagggcttgacatcccactaacgaagcagagatgcattaggtgcccttcggggaaagtggagacaggtggtgcatggttgtcgtcagctcgtgtcgtgagatgttgggttaagtcccgcaacgagcgcaacccttattgttagttgctacgcaagagcactctagcgagactgccgttgacaaaacggaggaaggtggggacgacgtcaaatcatcatgccccttatgtcctgggccacacacgtactacaatggtggttaacagagggaggcaataccgcgaggtggagcaaatccctaaaagccatcccagttcggattgcaggctgaaacccgcctgtatgaagttggaatcgctagtaatcgcggatcagcatgccgcggtgaatacgttcccgggccttgtacacaccgcccgtcacaccatgagagtcgggaacacccgaagtccgtagcctaaccgcaaggagggcgcggccgaaggtgggttcgataattggggtgaagtcgtaacaaggtagccgtatcggaaggtgcggctgg

SEQ ID NO: 187 - DNA, 1526 bp, Artificial Sequence
  Clostridium_oroticum
gtttgatcctggctcaggatgaacgctggcggcgtgcttaacacatgcaagtcgagcgaagcacaatactcaagatttcttcggattgaagagtgttgcgactgagcggcggacgggtgagtaacgcgtgggtaacctgcctcatacagggggataacagttagaaatgactgctaataccgtataagaccacagtgccgcatggcacagtggtaaaaactccggtggtatgagatggacccgcgtctgattagctagttggtaaggtaacggcttaccaaggcgacgatcagtagccgacctgagagggtgaccggccacattgggactgagacacggcccaaactcctacgggaggcagcagtggggaatattgcacaatgggggaaaccctgacgcagcgacgccgcgtgaaggatgaagtatttcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggtgatgcaagtctgatgtgaaaacccggggctcaaccccgggactgcattggaaactgtgtgactagagtgtcggagaggtaagtggaattcctagtgtagcggtgaaatgcgtagatattaggaggaacaccagtggcgaaggcggcttactggacgatgactgacgttgaggctcgaaagcgtggggagcaaacaggattagataccctggtagtccacgccgtaaacgatgaatactaggtgtcgggtggcaaagccattcggtgccgcagcaaacgcagtaagtattccacctggggagtacgttcgcaagaatgaaactcaaaggaattgacggggacccgcacaagcggtggagcatgtggtttaattcgaagcaacgcgaagaaccttacctgctcttgacatcccgctgaccggccagtaatgtggccttcccttcggggcagtggagacaggtggtgcatggttgtcgtcagctcgtgtcgtgagatgttgggttaagtcccgcaacgagcgcaacccttatctttagtagccagcggcttggccgggcactctagagagactgccagggataacctggaggaaggtggggatgacgtcaaatcatcatgccccttatgagcagggctacacacgtgctacaatggcgtaaacaaagggaggcaatactgtgaagtggagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagttggtaacgcccgaagtcagtgacccaaccgcaaggagggagctgccgaaggtgggaccgataactggggtgaagtcgtaacaaggtagccgtatcggaaggtgcggctggatcacctcctttct

SEQ ID NO: 188 - DNA, 1476 bp, Artificial Sequence
  Clostridium_paraputrificum
agagtttgatcctggctcaggacgaacgctggcggcgtgcctaacacatgcaagtcgagcgatgaagttccttcgggaacggattagcggcggacgggtgagtaacacgtgggcaacctgccttatagaggggaatagccttccgaaaggaagattaataccgcataagattgtagcttcgcatgaagtagcaattaaaggagcaatccgctataagatgggcccgcggcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgacggccttcgggttgtaaagctctgtctttggggacgataatgacggtacccaaggaggaagccacggctaactacgtgccagcagccgcggtaatacgtaggtggcaagcgttgtccggatttactgggcgtaaagggagcgtaggcggatttttaagtgggatgtgaaatacccgggctcaacctgggtgctgcattccaaactggaaatctagagtgcaggaggggaaagtggaattcctagtgtagcggtgaaatgcgtagagattaggaagaacaccagtggcgaaggcgactttctggactgtaactgacgctgaggctcgaaagcgtggggagcaaacaggattagataccctggtagtccacgccgtaaacgatgaatactaggtgtaggggttgtcatgacctctgtgccgccgctaacgcattaagtattccgcctggggagtacggtcgcaagattaaaactcaaaggaattgacgggggcccgcacaagtagcggagcatgtggtttaattcgaagcaacgcgaagaaccttacctagacttgacatctcctgaattaccatgtaatgtgggaagtcctttcggggacaggaagacaggtggtgcatggttgtcgtcagctcgtgtcgtgagatgttgggttaagtcccgcaacgagcgcaacccttattgttagttgctaccatttagttgagcactctagcgagactgcccgggttaaccgggaggaaggtggggatgacgtcaaatcatcatgccccttatgtctagggctacacacgtgctacaatggccggtacaacgagatgcaataccgtgaggtggagcaaaactataaaaccggtctcagttcggattgtaggctgaaactcgcctacatgaagctggagttactagtaatcgcgaatcagaatgtcgcggtgaatacgttcccgggccttgtacacaccgcccgtcacaccatgagagttggcaatacccaaagttggtgatctaacccgtaagggaggaagccacctaaggtagggtcagcgattggggtgaagtcgtaacaaggtaacc

SEQ ID NO: 189 - DNA, 1529 bp, Artificial Sequence
  Clostridium_scindens
gagagtttgatcctggctcaggatgaacgctggcggcgtgcctaacacatgcaagtcgaacgaagcgcctggccccgacttcttcggaacgaggagccttgcgactgagtggcggacgggtgagtaacgcgtgggcaacctgccttgcactgggggataacagccagaaatggctgctaataccgcataagaccgaagcgccgcatggcgcggcggccaaagccccggcggtgcaagatgggcccgcgtctgattaggtagttggcggggtaacggcccaccaagccgacgatcagtagccgacctgagagggtgaccggccacattgggactgagacacggcccagactcctacgggaggcagcagtggggaatattgcacaatgggggaaaccctgatgcagcgacgccgcgtgaaggatgaagtatttcggtatgtaaacttctatcagcagggaagaagatgacggtacctgactaagaagccccggctaactacgtgccagcagccgcggtaatacgtagggggcaagcgttatccggatttactgggtgtaaagggagcgtagacggcgatgcaagccagatgtgaaagcccggggctcaaccccgggactgcatttggaactgcgtggctggagtgtcggagaggcaggcggaattcctagtgtagcggtgaaatgcgtagatattaggaggaacaccagtggcgaaggcggcctgctggacgatgactgacgttgaggctcgaaagcgtggggagcaaacaggattagataccctggtagtccacgccgtaaacgatgactactaggtgtcgggtggcaaggccattcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctgatcttgacatcccgatgccaaagcgcgtaacgcgctctttcttcggaacatcggtgacaggtggtgcatggttgtcgtcagctcgtgtcgtgagatgttgggttaagtcccgcaacgagcgcaacccctatcttcagtagccagcattttggatgggcactctggagagactgccagggagaacctggaggaaggtggggatgacgtcaaatcatcatgccccttatgaccagggctacacacgtgctacaatggcgtaaacaaagggaggcgaacccgcgagggtgggcaaatcccaaaaataacgtctcagttcggattgtagtctgcaactcgactacatgaagttggaatcgctagtaatcgcgaatcagaatgtcgcggtgaatacgttcccgggtcttgtacacaccgcccgtcacaccatgggagtcagtaacgcccgaagccggtgacccaacccgtaagggagggagccgtcgaaggtgggaccgataactggggtgaagtcgtaacaaggtagccgtatcggaaggtgcggctggatcacctccttc

SEQ ID NO: 190 - DNA, 1405 bp, Artificial Sequence
  Clostridium_sordellii
ggcggcgtgcctaacacatgcaagtcgagcgatctcttcggagagagcggcggacgggtgagtaacgcgtgggtaacctgccctgtacacacggataacataccgaaaggtatactaatacgggataacatatgaaagtcgcatggcttttgtatcaaagctccggcggtacaggatggacccgcgtctgattagctagttggtaaggtaatggcttaccaaggcaacgatcagtagccgacctgagagggtgatcggccacactggaactgagacacggtccagactcctacgggaggcagcagtggggaatattgcacaatgggcgaaagcctgatgcagcaacgccgcgtgagcgatgaaggccttcgggtcgtaaagctctgtcctcaaggaagataatgacggtacttgaggaggaagccccggctaactacgtgccagcagccgcggtaatacgtagggggctagcgttatccggaattactgggcgtaaagggtgcgtaggtggttttttaagtcagaagtgaaaggctacggctcaaccgtagtaagcttttgaaactagagaacttgagtgcaggagaggagagtagaattcctagtgtagcggtgaaatgcgtagatattaggaggaataccagtagcgaaggcggctctctggactgtaactgacactgaggcacgaaagcgtggggagcaaacaggattagataccctggtagtccacgccgtaaacgatgagtactaggtgtcgggggttacccccctcggtgccgcagctaacgcattaagtactccgcctgggaagtacgctcgcaagagtgaaactcaaaggaattgacggggacccgcacaagtagcggagcatgtggtttaattcgaagcaacgcgaagaaccttacctaagcttgacatcccactgacctctccctaatcggagatttcccttcggggacagtggtgacaggtggtgcatggttgtcgtcagctcgtgtcgtgagatgttgggttaagtcccgcaacgagcgcaacccttgcctttagttgccagcattaagttgggcactctagagggactgccgaggataactcggaggaaggtggggatgacgtcaaatcatcatgccccttatgcttagggctacacacgtgctacaatgggtggtacagagggttgccaagccgcgaggtggagctaatcccttaaagccattctcagttcggattgtaggctgaaactcgcctacatgaagctggagttactagtaatcgcagatcagaatgctgcggtgaatgcgttcccgggtcttgtacacaccgcccgtcacaccatggaagttgggggcgcccgaagccggttagctaaccttttaggaagcggccgtcgagagctaaaccagta

SEQ ID NO: 191 - DNA, 1515 bp, Artificial Sequence
  Clostridium_sp_7_2_43FAA
attgagagtttgatcctggctcaggacgaacgctggcggcgtgcctaacacatgcaagtcgagcgagaggagttccttcgggaacaaatctagcggcggacgggtgagtaacacgtgggcaacctgccttgtagaggggaatagccttccgaaaggaagattaataccgcataacattacattttcgcatgaagaagtaattaaaggagcaatccgctacaagatgggcccgcggcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgaaggttttcggatcgtaaagctctgtcttcagggacgataatgacggtacctgaggaggaagccacggctaactacgtgccagcagccgcggtaatacgtaggtggcgagcgttgtccggatttactgggcgtaaagggagcgtaggcggatttttaagtgagatgtgaaatacccgggctcaacttgggtgctgcatttcaaactggaagtctagagtgcaggagaggagagtggaattcctagtgtagcggtgaaatgcgtagagattaggaagaacaccagtggcgaaggcgactctctggactgtaactgacgctgaggctcgaaagcgtggggagcaaacaggattagataccctggtagtccacgccgtaaacgatgaatactaggtgtaggggttgtcatgacctctgtgccgccgcaaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgcattactcttaatcgaggaagtcctttcggggacaggatgacaggtggtgcatggttgtcgtcagctcgtgtcgtgagatgttgggttaagtcccgcaacgagcgcaacccttattgttagttgctaccatttagttgagcactctagcgagactgcccgggttaaccgggaggaaggtggggatgacgtcaaatcatcatgccccttatgtctagggctacacacgtgctacaatggcaagtacaaagagatgcgataccgcgaggtggagctaaactataaaacttgtctcagttcggattgtaggctgaaactcgcctacatgaagctggagttgctagtaatcgcgaatcagaatgtcgcggtgaatacgttcccgggccttgtacacaccgcccgtcacaccatgagagttggcaatacccaaagttcgtgagctaacccgtaagggaggcagcgacctaaggtagggtcagcgattggggtgaagtcgtaacaaggtagccgtaggagaacctgcggctggatcacctcctttct

SEQ ID NO: 192 - DNA, 1529 bp, Artificial Sequence
  Clostridium_sp_D5
gagagtttgatcctggctcaggatgaacgctggcggcgtgcttaacacatgcaagtcgagcgaagcgctttacttagatttcttcggattgaagagttttgcgactgagcggcggacgggtgagtaacgcgtgggtaacctgcctcatacagggggataacagttagaaatgactgctaataccgcataagaccacggtaccgcatggtacagtgggaaaaactccggtggtatgagatggacccgcgtctgattagctagttggtaaggtaacggcttaccaaggcgacgatcagtagccgacctgagagggtgaccggccacattgggactgagacacggcccaaactcctacgggaggcagcagtggggaatattgcacaatgggggaaaccctgatgcagcgacgccgcgtgaaggatgaagtatttcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggttatgtaagtctgatgtgaaaacccggggctcaaccccgggactgcattggaaactatgtaactagagtgtcggagaggtaagtggaattcctagtgtagcggtgaaatgcgtagatattaggaggaacaccagtggcgaaggcggcttactggacgatcactgacgttgaggctcgaaagcgtggggagcaaacaggattagataccctggtagtccacgccgtaaacgatgaatactaggtgtcgggtggcaaagccattcggtgccgcagcaaacgcaataagtattccacctggggagtacgttcgcaagaatgaaactcaaaggaattgacggggacccgcacaagcggtggagcatgtggtttaattcgaagcaacgcgaagaaccttacctgctcttgacatcccactgaccggcgtgtaatggcgccttcccttcggggcagtggagacaggtggtgcatggttgtcgtcagctcgtgtcgtgagatgttgggttaagtcccgcaacgagcgcaacccttatctttagtagccagcggtttggccgggcactctagagagactgccagggataacctggaggaaggtggggatgacgtcaaatcatcatgccccttatgagcagggctacacacgtgctacaatggcgtaaacaaagggaggcaataccgcgaggttgagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagttggtaacgcccgaagtcagtgacccaaccgtaaggagggagctgccgaaggcgggatcgataactggggtgaagtcgtaacaaggtagccgtatcggaaggtgcggctggatcacctcctttct

SEQ ID NO: 193 - DNA, 1543 bp, Artificial Sequence
  Clostridium_sp_HGF2
tcaaatggagagtttgatcctggctcaggatgaacgctggcggcatgcctaatacatgcaagtcgaacgaagtttcgaggaagcttgcttccaaagagacttagtggcgaacgggtgagtaacacgtaggtaacctgcccatgtgtccgggataactgctggaaacggtagctaaaaccggataggtatacagagcgcatgctcagtatattaaagcgcccatcaaggcgtgaacatggatggacctgcggcgcattagctagttggtgaggtaacggcccaccaaggcgatgatgcgtagccggcctgagagggtaaacggccacattgggactgagacacggcccaaactcctacgggaggcagcagtagggaattttcgtcaatgggggaaaccctgaacgagcaatgccgcgtgagtgaagaaggtcttcggatcgtaaagctctgttgtaagtgaagaacggctcatagaggaaatgctatgggagtgacggtagcttaccagaaagccacggctaactacgtgccagcagccgcggtaatacgtaggtggcaagcgttatccggaatcattgggcgtaaagggtgcgtaggtggcgtactaagtctgtagtaaaaggcaatggctcaaccattgtaagctatggaaactggtatgctggagtgcagaagagggcgatggaattccatgtgtagcggtaaaatgcgtagatatatggaggaacaccagtggcgaaggcggtcgcctggtctgtaactgacactgaggcacgaaagcgtggggagcaaataggattagataccctagtagtccacgccgtaaacgatgagaactaagtgttggaggaattcagtgctgcagttaacgcaataagttctccgcctggggagtatgcacgcaagtgtgaaactcaaaggaattgacgggggcccgcacaagcggtggagtatgtggtttaattcgaagcaacgcgaagaaccttaccaggccttgacatggaaacaaataccctagagatagggggataattatggatcacacaggtggtgcatggttgtcgtcagctcgtgtcgtgagatgttgggttaagtcccgcaacgagcgcaacccttgtcgcatgttaccagcatcaagttggggactcatgcgagactgccggtgacaaaccggaggaaggtggggatgacgtcaaatcatcatgccccttatggcctgggctacacacgtactacaatggcgaccacaaagagcagcgacttggtgacaagaagcgaatctcataaaggtcgtctcagttcggattgaagtctgcaactcgacttcatgaagtcggaatcgctagtaatcgcagatcagcatgctgcggtgaatacgttctcgggccttgtacacaccgcccgtcaaaccatgggagtcagtaatacccgaagccggtggcataaccgtaaggagtgagccgtcgaaggtaggaccgatgactggggttaagtcgtaacaaggtatccctacgggaacgtggggatggatcacctcctttct

SEQ ID NO: 194 - DNA, 1512 bp, Artificial Sequence
  Clostridium_spiroforme
gagagtttgatcctggctcaggatgaacgctggcggctgcctaatacatgcaagtcgaacgcgagcagcaatgctcgagtggcgaacgggtgagtaatacataagtaacctgccctagacagggggataactgctggaaaccagctaagaccgcataggtatggacactgcatggtgaccatattaaaagtgccaaggcactggtagaggatggacttatggcgcattagctggttggtgaggtaacagctcaccaaggcgacgatgcgtagccgacctgagagggtgaccggccacactgggactgagacacggcccagactcctacgggaggcagcagtagggaattttcggcaatggggggaaccctgaccgagcaacgccgcgtgaaggaagaaggaattcgttctgtaaacttctgttataaaggaagaacggcggatatagggaatgatatccgagtgacggtactttatgagaaagccacggctaactacgtgccagcagccgcggtaatacgtaggtggcgagcgttatccggaattattgggcgtaaagagggagcaggcggcggcagaggtctgtggtgaaagactgaagcttabacttcagtaagccatagaaaccgggctgctagagtgcaggagaggatcgtggaattcctgtgtagcggtgaaatgcgtagatatatggaggaacaccagtggcgaaggcgacggtctggcctgtaactgacgctcattcccgaaagcgtggggagcaaataggattagataccctagtagtccacgccgtaaacgatgagtactaagtgttgggagtcaaatttcagtgctgcagttaacgcaataagtactccgcctgagtagtacgttcgcaagaatgaaactcaaaggaattgacgggggccgcacaagcggtggagcatgtggtttaattcgaagcaacgcgaagaaccttaccaggtcttgacatccggataaagacctcagagatgaggggatagatatatccgagacaggtggtgcatggttgtcgtcagctcgtgtcgtgagatgttgggttaagtcccgcaacgagcgcaacccttgtcgctagttaccatcattaagttggggactctagcgagactgccagtgacaagctggaggaaggcggggatgacgtcaaatcatcatgccccttatgacctgggctacacacgtgctacaatggatggagcagagggaagcgaagccgcgaggtgaagcaaaacccataaaaccattctcagttcggattgtagtctgcaactcgactacatgaagttggaatcgctagtaatcgcgaatcagcatgtcgcggtgaatacgttctcgggccttgtacacaccgcccgtcacaccatgagagttgataacacccgaagccggtggcctaaccgcaaggagggagctgtctaaggtgggattgatgattggggtgaagtcgtaacaaggtatccctacgggaacgtgcggctggatcacctcc

SEQ ID NO: 195 - DNA, 1364 bp, Artificial Sequence
  Clostridium_sp_MT4_E
catgcacgtcgagcgactcttctggagagagcggcggacgggagagcacgcgagggtacctgccctgtcacacggataacactaccgaaaggtatactaatacggggactaacatactgaaagtcgcatggcttttgtatcaaagctccggcggtacaggatggacccgcgtctgattagctagttggtaaggtaatggcttaccaaggcaacgatcagtagccgaccttgagaagggtgaatcgggccactactggaaatgaagacacgggtccaagactcctactggggaggcagcagtggggaatattgcacaatgggcgaaagcctgatgcagcaacgccgcgtgagcggatgaaggccttcgggtcgtaaagctctgtcctcaaggaagataatgacgggtactttgaggaggaagccccgggctaactacgtgccagcagccgcgggtaatacggtagggggctagcgttatccgggaaattactgggcgtaaagggtgcggtaaggtggtttttttaagtcagaagtgaaaggctacggctcaaccggtagtaagctttttgaaactagagaactttgagtgcaggagaggagagtagaattcctagtgtagcggtgaaatgcgtaaatttaggaggaataccagtagcgaaggcggcttctctggacttgtaactgacactgaggccgaaagcgggggagcaacaggattagatccctggtagtcccgccgtaaacgatgagtactagggtgtcgggggttacccccctcggtgccgcagctaacgcattaagtactccgcctgggaagtacgctcgcaagagtaaactcaaaggaattgaccgggacccgcacaaagtagcggagcatgtggtttaattcgaagcaaacgcgaagaaccttacctaagcttgacatcccactgacctctccctaaatcggagatttcccttcggggccagtggtgacaggtggtgcatggttgtcgtcagctcgtgtcgtgagatgttgggttaagtcccgcaacgagcgcaacccttgcctttagttgccagcattaagttgggcactctagagggactgccgaggataactcggaggaaggtggggatgacgtcaaatcatcatgccccttatgcttagggctacaccaccgtgctacaatgggtggtacagagggttgccaagccgcgaaggtggagctaatcccttaaagccattctcagttcggattgtaggctgaaactcgcctacatgaagctggagttactagtaatcgcaatcagaatgctgcggtgatgcgttcccgggtcttgtacacaccgcccgtcacaccattggaagttggggcgccaga

SEQ ID NO: 196 - DNA, 1471 bp, Artificial Sequence
  Clostridium_sp_NML_04A032
acgctggcggcgtgcttaacacatgcaagtcgaacggggtgcctatgatagaggattcgtccaattgattaggctacctagtggcggacgggtgagtaacgcgtgagtaacctgccttggagtggggaataacagtccgaaaggactgctaataccgcatgatgcagcgaggtcgcatggccttgctgccaaagatttatcgctctgagatggactcgcgtctgattagctggttggcggggtaacggcccaccaaggcgacgatcagtagccggactgagaggttggccggccacattgggactgagacacggcccagactcctacgggaggcagcagtggggaatattgggcaatgggcgcaagcctgacccagcaacgccgcgtgaaggaagaaggctctcgggttgtaaacttcttttatcagggacgaaagaaatgacggtacctgatgaataagccacggctaactacgtgccagcagccgcggtaatacgtaggtggcaagcgttatccggatttactgggtgtaaagggcgtgtaggcgggaaagcaagtcaggcgtgaaaactatgggctcaacccatagcctgcgtttgaaactgtttttcttgagtgtcggagaggcaatcggaattccgtgtgtagcggtgaaatgcgtagatatacggaggaacaccagtggcgaaggcggattgctggacgataactgacgctgaggcgcgaaagcgtggggagcaaacaggattagataccctggtagtccacgccgtaaacgatggatactaggtgtggggggtctgaccccctccgtgccgcagttaacacaataagtatcccacctggggagtacgatcgcaaggttgaaactcaaaggaattgacgggggcccgcacaagcggtggagtatgtggtttaattcgaagcaacgcgaagaaccttaccagggcttgacatcgtactaacgaagcagagatgcattaggtgcccttcggggaaagtatagacaggtggtgcatggttgtcgtcagctcgtgtcgtgagatgttgggttaagtcccgcaacgagcgcaacccctattgttagttgctacgcaagagcactctagcgagactgccgttgacaaaacggaggaaggtggggacgacgtcaaatcatcatgccccttatgtcctgggccacacacgtactacaatggcggtcaacagagggaggcaataccgcgaggtggagcaaatccctaaaagccgtcccagttcggattgcaggctgaaacccgcctgcatgaagttggaatcgctagtaatcgcggatcagcatgccgcggtgaatacgttcccgggccttgtacacaccgcccgtcacaccatgagagtcgggaacacccgaagtccgtagcctaaccgcaaggggggcgcggccgaaggtgggttcgataattggggtgaagtcgtaacaaggtagccgtat

SEQ ID NO: 197 - DNA, 1320 bp, Artificial Sequence
  Clostridium_sp_YIT_12069
gacgaacgctggcggcgtgcctaacacatgcaagtcgaacgagtggcggacgggtgagtaacgcgtgagcaacctgcctcaaagagggggataacgtctggaaacggacgctaataccgcatgaccaaagccgctttgagatgggctcgcgtctgattagctagttggtggggtaaaggcctaccaaggcgacgatcagtagccggactgagaggttgaacggccacattgggactgagacacggcccagactcctacgggaggcagcagtgggggatattgcacaatgggggaaaccctgatgcagcaacgccgcgtgaaggaagacggttttcggattgtaaacttctgttcttagtgacgatgacggtagctaaggagaaagctccggctaactacgtgccagcagccgcggtaatacgtagggagcgagcgttgtccggaattactgggtgtaaagggagcgtaggcgggagatcaagtcagatgtgaaaactatgggctcaacccataacctgcatttgaaactgttcttcttgagtgaagtagaggcaggcggaattccgagtgtagcggtgaaatgcgtagatattcggaggaacaccagtggcgaaggcggcctgctgggcttactgacgctgaggctcgaaagcatggggagcaaacaggattagataccctggtagtccatgccgtaaacgatgattactaggtgtggggtattccgtgccggagttaacacaataagtaatccacctggggagtacggccgcaaggttgaaactcaaaggaattgacgggggcccgcacaagcagtggagtatgtggtttaattcgaagcaacgcgaagaaccttaccaggtcttgacatcgacaggtggtgcatggttgtcgtcagctcgtgtcgtgagatgttgggttaagtcccgcaacgagcgcaacccttgtcattagttgctacagcactctaatgagactgccgttgacaaaacggaggaaggtggggacgacgtcaaatcatcatgccccttatgacctgggctacacacgtactacaatggccgtcagagggaagcaatactgtgaagtggagcaaacccctacggtcccagttcagatgcaggctgcaacccgcctgcagaagtcggaattgctagtaatcgcggatcagcatgccgcggtgaatacgttcccgggccttgtacacaccgcccgtcacaccatgggagccggtaatacccgaagtcggtgtctaggacgccgccgaaggtaggattggcgactggggtgaagtcgtaacaaggtagccgtatcggaagg

SEQ ID NO: 198 - DNA, 1535 bp, Artificial Sequence
  Clostridium_symbiosum
ttaaacatgagagtttgatcctggctcaggatgaacgctggcggcgtgcctaacacatgcaagtcgaacgaagcaatttaacggaagttttcggatggaagttgaattgactgagtggcggacgggtgagtaacgcgtgggtaacctgccttgtactgggggacaacagttagaaatgactgctaataccgcataagcgcacagtatcgcatgatacagtgtgaaaaactccggtggtacaagatggacccgcgtctgattagctagttggtaaggtaacggcttaccaaggcgacgatcagtagccgacctgagagggtgaccggccacattgggactgagacacggcccaaactcctacgggaggcagcagtggggaatattgcacaatgggcgaaagcctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggtaaagcaagtctgaagtgaaagcccgcggctcaactgcgggactgctttggaaactgtttaactggagtgtcggagaggtaagtggaattcctagtgtagcggtgaaatgcgtagatattaggaggaacaccagtggcgaaggcgacttactggacgataactgacgttgaggctcgaaagcgtggggagcaaacaggattagataccctggtagtccacgccgtaaacgatgaatactaggtgttggggagcaaagctcttcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaggtcttgacatcgatccgacgggggagtaacgtccccttcccttcggggcggagaagacaggtggtgcatggttgtcgtcagctcgtgtcgtgagatgttgggttaagtcccgcaacgagcgcaacccttattctaagtagccagcggttcggccgggaactcttgggagactgccagggataacctggaggaaggtggggatgacgtcaaatcatcatgccccttatgatctgggctacacacgtgctacaatggcgtaaacaaagagaagcaagaccgcgaggtggagcaaatctcaaaaataacgtctcagttcggactgcaggctgcaactcgcctgcacgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggagggagctgccgaaggcgggaccgataactggggtgaagtcgtaacaaggtagccgtatcggaaggtgcggctggatcacctcctttct

SEQ ID NO: 199 - DNA, 1535 bp, Artificial Sequence
  Clostridium_symbiosum
ttaaacatgagagtttgatcctggctcaggatgaacgctggcggcgtgcctaacacatgcaagtcgaacgaagcgattcaacggaaattttcggatggaagttgaattgactgagtggcggacgggtgagtaacgcgtgggtaacctgccttgtactgggggacaacagttagaaatgactgctaataccgcataagcgcacagtatcgcatgatacagtgtgaaaaactccggtggtacaagatggacccgcgtctgattagctagttggtaaggtaacggcttaccaaggcgacgatcagtagccgacctgagagggtgaccggccacattgggactgagacacggcccaaactcctacgggaggcagcagtggggaatattgcacaatgggcgaaagcctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggtaaagcaagtctgaagtgaaagcccgcggctcaactgcgggactgctttggaaactgtttaactggagtgtcggagaggtaagtggaattcctagtgtagcggtgaaatgcgtagatattaggaggaacaccagtggcgaaggcgacttactggacgataactgacgttgaggctcgaaagcgtggggagcaaacaggattagataccctggtagtccacgccgtaaacgatgaatactaggtgttggggagcaaagctcttcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaggtcttgacatcgatccgacgggggagtaacgtccccttcccttcggggcggagaagacaggtggtgcatggttgtcgtcagctcgtgtcgtgagatgttgggttaagtcccgcaacgagcgcaacccttattctaagtagccagcggttcggccgggaactcttgggagactgccagggataacctggaggaaggtggggatgacgtcaaatcatcatgccccttatgatctgggctacacacgtgctacaatggcgtaaacaaagagaagcaagaccgcgaggtggagcaaatctcaaaaataacgtctcagttcggactgcaggctgcaactcgcctgcacgaagctggaatcgctagtaatcgcgaatcagaatgtcgcggtgaatacgttcccgggtcttgtacacaccgcccgtcacaccatgggagtcagtaacgcccgaagtcagtgacccaaccgcaaggagggagctgccgaaggcgggaccgataactggggtgaagtcgtaacaaggtagccgtatcggaaggtgcggctggatcacctcctttct

SEQ ID NO: 200 - DNA, 1482 bp, Artificial Sequence
  Clostridium_viride
  misc_feature (746)..(746): n is a, c, g, or t
gatgaacgctggcggcgtgcttaacacatgcaagtcgaacggagccatctggaacaagttttcggacaagggaaagatgtgcttagtggcggacgggtgagtaacgcgtgagtaacctgccttggagtggggaataacacatcgaaaggtgtgctaataccgcatgatgcaacgggatcgcatggttctgttgccaaagatttatcgctctgagatggactcgcgtctgattagctagttggtgaggtaatggctcaccaaggcgacgatcagtagccggactgagaggttgaccggccacattgggactgagacacggcccagactcctacgggaggcagcagtggggaatattgggcaatgggcgcaagcctgacccagcaacgccgcgtgaaggaagaaggccctcgggttgtaaacttcttttattcgagacgaaacaaatgacggtaccgaatgaataagccacggctaactacgtgccagcagccgcggtaatacgtaggtggcaagcgttatccggatttactgggtgtaaagggcgtgtaggcgggactgcaagtcagatgtgaaattccagggctcaactctggacctgcatttgaaactgtagttcttgagtgatggagaggcaggcggaattccgagtgtagcggtgaaatgcgtagatattcggaggaacaccagtggcgaaggcggcctgctggacattaactgacgctgaggcgcgaaagcgtggggagcanacaggattagataccctggtagtccacgctgtaaacgatggatactaggtgtggggggactgaccccttccgtgccgcagttaacacaataagtatcccacctggggagtacgatcgcaaggttgaaactcaaaggaattgacgggggcccgcacaagcggtggagtatgtggtttaattcgaagcaacgcgaagaaccttaccagggcttgacatccctctgaccggtctagagataggccctccctcggggcagaggtgacaggtggtgcatggttgtcgtcagctcgtgtcgtgagatgttgggttaagtcccgcaacgagcgcaacccctattgttagttgctacgcaagagcactctagcgagactgccgttgacaaaacggaggaaggtggggacgacgtcaaatcatcatgccccttatgtcctgggctacacacgtactacaatggcgcttaacagagggaggcaataccgcgaggtggagcaaacccctaaaaggcgtcccagttcggattgcaggctgaaacccgcctgtatgaagttggaatcgctagtaatcgcggatcagcatgccgcggtgaatacgttcccgggtcttgtacacaccgcccgtcacaccatgagagtcgggaacacccgaagtccgtagcctaacagcaatgagggcgcggccgaaggtgggttcgataattggggtgaagtcgtaacaaggtagccgtatcggaaggtgc

SEQ ID NO: 201 - DNA, 1511 bp, Artificial Sequence
  Collinsella_aerofaciens
tttggacggagagttcgatcctggctcaggatgaacgctggcggcgcgcctaacacatgcaagtcgaacggcacccctctccggagggaagcgagtggcgaacggctgagtaacacgtggagaacctgccccctcccccgggatagccgcccgaaaggacgggtaataccggataccccggggtgccgcatggcgccccggctaaagccccgacgggaggggatggctccgcggcccatcaggtagacggcggggtgacggcccaccgtgccgacaacgggtagccgggttgagagaccgaccggccagattgggactgagacacggcccagactcctacgggaggcagcagtggggaatcttgcgcaatggggggaaccctgacgcagcgacgccgcgtgcgggacggaggccttcgggtcgtaaaccgctttcagcagggaagagtcaagactgtacctgcagaagaagccccggctaactacgtgccagcagccgcggtaatacgtagggggcgagcgttatccggattcattgggcgtaaagcgcgcgtaggcggcccggcaggccgggggtcgaagcggggggctcaaccccccgaagcccccggaacctccgcggcttgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacgctaggtgtggggggacgatccccccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatatgggtgaagcgggggagaccccgtggccgagaggagcccatacaggtggtgcatggctgtcgtcagctcgtgtcgtgagatgttgggttaagtcccgcaacgagcgcaacccccgccgcgtgttgccatcgggtgatgccgggaacccacgcgggaccgccgccgtcaaggcggaggagggcggggacgacgtcaagtcatcatgccccttatgccctgggctgcacacgtgctacaatggccggtacagagggatgccaccccgcgagggggagcggatcccggaaagccggccccagttcggattgggggctgcaacccgcccccatgaaagtcggagttgctagtaatcgcggatcagcatgccgcggtgaatgcgttcccgggccttgtacacaccgcccgtcacaccacccgagtcgtctgcacccgaagtcgccggcccaaccgagaggggggaggcgccgaaggtgtggagggtgaggggggtgaagtcgtaacaaggtagccgtaccggaaggtgcggctggatcacctcctttct

SEQ ID NO: 202 - DNA, 1511 bp, Artificial Sequence
  Collinsella_intestinalis
ttggacggagagttcgatcctggctcaggatgaacgctggcggcgcgcctaacacatgcaagtcgaacggcacccaccctcgggtggaagcgagtggcgaacggctgagtaacacgtggagaacccgccccctcctccgggatagcctcgggaaaccgtgggtaataccggatgaccccgcagggccgcatggccccgcgggcaaagcccagacgggaggggatggctccgcggcccatcaggtagacggcggggtgacggcccaccgtgccgacgacgggtagccgggttgagagaccgaccggccagattgggactgagacacggcccagactcctacgggaggcagcagtggggaatcttgcgcaatggggggaacccgtgacgcagcgacgccgcgtgcgggacgaaggccctcgggtcgtaaaccgctttcagcagggatgagacaagacggtacctgcagaagaagccccggctaactacgtgccagcagccgcggtaatacgtagggggcgagcgttatccggattcattgggcgtaaagcgcgcgtaggcggcccggcaggcagggggtcaaatggcggggctcaaccccgtcccgccccctgaaccgccgggctcgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacgctaggtgtggggggacgatccctccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatgaccgtgaagccggggagacccggtggccgagaggagcggtcacaggtggtgcatggctgtcgtcagctcgtgtcgtgagatgtttggttaagtccagcaacgagcgcaacccccgccgccatgttgccagcacctcgggtggggcacccatgcgggaccgccggagtcaatccggaggagggcggggacgacgtcaagtcatcatgccccttatgccctgggctgcacacgtgctacaatggccggtacagcgggatgcgatggcgcgagccggagcggatccctgaaagccggccccagttcggattgggggctgcaacccgcccccatgaagtcggagttgctagtaatcgcggatcagcatgccgcggtgaatgcgttcccgggccttgtacacaccgcccgtcacaccacccgagtcgtctgcacccgaagtcgccggcccaaccatctggggggaggcgccgaaggtgtggagggtgaggggggtgaagtcgtaacaaggtagccgtacgggaacgtgcggctggatcacctcctttct

SEQ ID NO: 203 - DNA, 1509 bp, Artificial Sequence
  Collinsella_stercoris
tttggacggagagttcgatcctggctcaggatgaacgctggcggcgcgcctaacacatgcaagtcgaacggcacccgccctcgggcggaagcgagtggcgaacggctgagtaacacgtggagaacccgccccctcctccgggatagcctcgggaaaccgtgggtaataccggatgaccccggcaggccgcatggccggccgggcaaagcccagacgggaggggatggctccgcggcccatcaggtagacggcggggtgacggcccaccgtgccgacgacgggtagccgggttgagagaccgaccggccagattgggactgagacacggcccagactcctacgggaggcagcagtggggaatcttgcgcaatggggggaaccctgacgcagcgacgccgcgtgcgggacgaaggccctcgggtcgtaaaccgctttcagcagggatgagacaagacggtacctgcagaagaagccccggctaactacgtgccagcagccgcggtaatacgtagggggcgagcgttatccggattcattgggcgtaaagcgcgcgtaggcggcccggcaggcagggggtcaaatggcggggctcaaccccgtcccgccccctgaaccgccgggctcgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacgctaggtgtgggaggggaacccttccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatgcgcgtgaagccggggagacccggtggccgagaggagcgcgcacaggtggtgcatggctgtcgtcagctcgtgtcgtgagatgtttggttaagtccagcaacgagcgcaacccccgccgcatgttgccagcacctcgggtgggcacccatgcgggaccgccggagtcaatccggaggagggcggggacgacgtcaagtcatcatgccccttatgccctgggctgcacacgtgctacaatggccggtacagcgggatgcgatggcgcgagccggagcggatccctgaaagccggccccagttcggattgggggctgcaacccgcccccatgaagtcggagttgctagtaatcgcggatcagcatgccgcggtgaatgcgttcccgggccttgtacacaccgcccgtcacaccacccgagtcgtctgcacccgaagtcgccggcccaaccgagaggggggaggcgcctaaggtgtggagggtgaggggggtgaagtcgtaacaaggtagccgtacgggaacgtgcggctggatcacctcctttct

SEQ ID NO: 204 - DNA, 1356 bp, Artificial Sequence
  Collinsella_tanakaei
tcatggctcaggatgaacgctggcggcgcgcctaacacatgcaagtcgaacgagtggcgaacggctgagtaacacgtggagaacctgccccctcctcggggatagccgcgggaaaccgcgggtaacacccgacgaccaaatgagggaggggatggctccgcggcccatcaggtagacggcggggtaacggcccaccgtgccgacaacgggtagccgggttgagagaccgaccggccagattgggactgagacacggcccagactcctacgggaggcagcagtggggaatcttgcgcaatgggggcaaccctgacgcagcgacgccgcgtgcgggacgaaggccttcgggtcgtaaaccgctttcagcagggacgaagacggtacctgcagaagaagccccggctaactacgtgccagcagccgcggtaatacgtagggggcgagcgttatccggattcattgggcgtaaagcgcgcgtaggcggccgcgtaggcggggggtcaaatcccggggctcaaccccggtccgccccccgaaccccgcggctcgggtccggtaggggagggtggaattcccggtgtagcggtggaatgcgcagatatcgggaggaacaccggtggcgaaggcggccctctgggccgaccgacgctgaggcgcgaaagctgggggagcgaacaggattagataccctggtagtcccagccgtaaacgatggacgctaggtgtgggggcctccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatgcacaggtggtgcatggctgtcgtcagctcgtgtcgtgagatgttgggttaagtcccgcaacgagcgcaacccccgccgcatgttgccagcagctgggcacccatgcgggaccgccggcgtcaagccggaggagggcggggacgacgtcaagtcatcatgccccttatgccctgggctgcacacgtgctacaatggccggcagcgggatgcgatggcgcgagccggagcggatccctcccggccccagttcggatgggggctgcaacccgcccccagaagtcggagttgctagtaatcgcggatcagcatgccgcggtgaatgcgttcccgggccttgtacacaccgcccgtcacaccacccgagtcgtctgcacccgaagccgccgcccagggaggcgtcgaaggtgtggagggtgaggggggtgaagtcgtaacaaggtagccgtacgggaacgtgcggctggatcacctcct

SEQ ID NO: 205 - DNA, 1325 bp, Artificial Sequence
  Collinsella_tanakaei
gatgaacgctggcggcgcgcctaacacatgcaagtcgaacgagtggcgaacggctgagtaacacgtggagaacctgccccctcctcggggatagccgcgggaaaccgcgggtaacacccgacgaccaaatgagggaggggatggctccgcggcccatcaggtagacggcggggtaacggcccaccgtgccgacaacgggtagccgggttgagagaccgaccggccagattgggactgagacacggcccagactcctacgggaggcagcagtggggaatcttgcgcaatgggggcaaccctgacgcagcgacgccgcgtgcgggacgaaggccttcgggtcgtaaaccgctttcagcagggacgaagacggtacctgcagaagaagccccggctaactacgtgccagcagccgcggtaatacgtagggggcgagcgttatccggattcattgggcgtaaagcgcgcgtaggcggccgcgtaggcggggggtcaaatcccggggctcaaccccggtccgccccccgaaccccgcggctcgggtccggtaggggagggtggaattcccggtgtagcggtggaatgcgcagatatcgggaggaacaccggtggcgaaggcggccctctgggccgaccgacgctgaggcgcgaaagctgggggagcgaacaggattagataccctggtagtcccagccgtaaacgatggacgctaggtgtgggggcctccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatgcacaggtggtgcatggctgtcgtcagctcgtgtcgtgagatgttgggttaagtcccgcaacgagcgcaacccccgccgcatgttgccagcagctgggcacccatgcgggaccgccggcgtcaagccggaggagggcggggacgacgtcaagtcatcatgccccttatgccctgggctgcacacgtgctacaatggccggcagcgggatgcgatggcgcgagccggagcggatccctcccggccccagttcggatgggggctgcaacccgcccccagaagtcggagttgctagtaatcgcggatcagcatgccgcggtgaatgcgttcccgggccttgtacacaccgcccgtcacaccacccgagtcgtctgcacccgaagccgccgcccagggaggcgtcgaaggtgtggagggtgaggggggtgaagtcgtaacaaggtagccgtacgggaac

SEQ ID NO: 206 - DNA, 1528 bp, Artificial Sequence
  Coprobacillus_sp_D7
gagagtttgatcctggctcaggatgaacgctggcggcgtgcctaatacatgcaagtcgaacgcgagcacttgtgctcgagtggcgaacgggtgagtaatacataagtaacctgccctagacagggggataactattggaaacgatagctaagaccgcataggtacggacactgcatggtgaccgtattaaaagtgcctcaaagcactggtagaggatggacttatggcgcattagctggttggcggggtaacggcccaccaaggcgacgatgcgtagccgacctgagagggtgaccggccacactgggactgagacacggcccagactcctacgggaggcagcagtagggaattttcggcaatgggggaaaccctgaccgagcaacgccgcgtgaaggaagaaggttttcggattgtaaacttctgttataaaggaagaacggcggctacaggaaatggtagccgagtgacggtactttattagaaagccacggctaactacgtgccagcagccgcggtaatacgtaggtggcaagcgttatccggaattattgggcgtaaagagggagcaggcggcagcaagggtctgtggtgaaagcctgaagcttaacttcagtaagccatagaaaccaggcagctagagtgcaggagaggatcgtggaattccatgtgtagcggtgaaatgcgtagatatatggaggaacaccagtggcgaaggcgacgatctggcctgcaactgacgctcagtcccgaaagcgtggggagcaaataggattagataccctagtagtccacgccgtaaacgatgagtactaagtgttggatgtcaaagttcagtgctgcagttaacgcaataagtactccgcctgagtagtacgttcgcaagaatgaaactcaaaggaattgacgggggcccgcacaagcggtggagcatgtggtttaattcgaagcaacgcgaagaaccttaccaggtcttgacatactcataaaggctccagagatggagagatagctatatgagatacaggtggtgcatggttgtcgtcagctcgtgtcgtgagatgttgggttaagtcccgcaacgagcgcaacccttatcgttagttaccatcattaagttggggactctagcgagactgccagtgacaagctggaggaaggcggggatgacgtcaaatcatcatgccccttatgacctgggctacacacgtgctacaatggatggtgcagagggaagcgaagccgcgaggtgaagcaaaacccataaaaccattctcagttcggattgtagtctgcaactcgactacatgaagttggaatcgctagtaatcgcgaatcagcatgtcgcggtgaatacgttctcgggccttgtacacaccgcccgtcacaccacgagagttgataacacccgaagccggtggcctaaccgcaaggaaggagctgtctaaggtgggattgatgattggggtgaagtcgtaacaaggtatccctacgggaacgtggggatggatcacctcctttctaagga

SEQ ID NO: 207 - DNA, 1527 bp, Artificial Sequence
  Coprococcus_comes
gagagtttgatcctggctcaggatgaacgctggcggcgtgcttaacacatgcaagtcgaacgaagcactttaacctgattcttcggatgaaggtttttgtgactgagtggcggacgggtgagtaacgcgtgggtaacctgcctcatacagggggataacagttagaaatgactgctaataccgcataagaccacagagccgcatggctcggtgggaaaaactccggtggtatgagatggacccgcgtctgattaggtagttggtggggtaacggcctaccaagccaacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaaaatgacggtacctgactaagaagcaccggctaaatacgtgccagcagccgcggtaatacgtatggtgcaagcgttatccggatttactgggtgtaaagggagcgtagacggctgtgtaagtctgaagtgaaagcccggggctcaaccccgggactgctttggaaactatgcagctagagtgtcggagaggtaagtggaattcccagtgtagcggtgaaatgcgtagatattgggaggaacaccagtggcgaaggcggcttactggacgatgactgacgttgaggctcgaaagcgtggggagcaaacaggattagataccctggtagtccacgccgtaaacgatgactactaggtgtcggggagcaaagctcttcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctgctcttgacatcccggtgaccggcgtgtaatgacgccttttcttcggaacaccggtgacaggtggtgcatggttgtcgtcagctcgtgtcgtgagatgttgggttaagtcccgcaacgagcgcaacccttatcttcagtagccagcaattcggatgggcactctggagagactgccagggataacctggaggaaggtggggatgacgtcaaatcatcatgccccttatgagcagggctacacacgtgctacaatggcgtaaacaaagggaagcgagcctgcgagggtaagcaaatctcaaaaataacgtctcagttcggattgtagtctgcaactcgactacatgaagctggaatcgctagtaatcgcgaatcagcatgtcgcggtgaatacgttcccgggtcttgtacacaccgcccgtcacaccatgggagttggtaacgcccgaagtcagtgacccaaccgtaaggagggagctgccgaaggtgggaccgataactggggtgaagtcgtaacaaggtagccgtatcggaaggtgcggctggatcacctcctttct

SEQ ID NO: 208 - DNA, 1440 bp, Artificial Sequence
  Coprococcus_eutactus
gatgaacgctggcggcgtgcttaacacatgcaagtcgaacgattgaagctggagcttgctccggccgatttagtggcggacgggtgagtaacgcgtgggtaacctgcctcatacagggggatagcagttggaaacgactggtaaaaccgcataagcgcacrgtatcgcatgatacagtgtgaaaacactccggtggtatgagatggacccgcgtctgattagctagttggtgaggtaacggcccaccaaggcgacgatcagtagccggcctgagagggtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagataatgacggtacctgactaagaagcaccggctaaatacgtgccagcagccgcggtaatacgtatggtgcaagcgttatccggatttactgggtgtaaagggtgcgtaggtggcaaggcaagtctgaagtgaaaatccggggctcaaccccggaactgctttggaaactgtttagctagagtacaggagaggtaagtggaattcctagtgtagcggtgaaatgcgtagatattaggaggaacaccagtggcgaaggcgacttactggactgctactgacactgaggcacgaaagcgtggggagcaaacaggattagataccctggtagtccacgccgtaaacgatgaatactaggtgttgggttccaaagggactcggtgccgtcgcaaacgcattaagtattccacctggggagtacgttcgcaagaatgaaactcaaaggaattgacggggacccgcacaagcggtggagcatgtggtttaattcgaagcaacgcgaaaaaccttaccaagtcttgacatcctgatgacggttccttaaccggaacttctcttcggagcatcagagacaggtggtgcatggttgtcgtcagctcgtgtcgtgagatgttgggttaagtcccgcaacgagcgcaacccctatttccagtagccagcagtaagatgggcactctggagagactgccggggataacccggaggaaggtggggatgacgtcaaatcatcatgccccttatgatttgggctacacacgtgctacaatggcagttacaaagagaagcraacctgtgaaggcgagcaaacctcaaaaaggctgtctcagttcggattgtagtctgcaactcgactacatgaagctggaatcgctagtaatcgcagatcagcatgctgcggtgaatacgttcccgggtcttgtacacaccgcccgtcacaccatgggagtcggtaacgcccgaagtcagtgacccaaccgcaaggagggagctgccgaaggcaggatcgataactggggtg

SEQ ID NO: 209 - DNA, 1464 bp, Artificial Sequence
  Coriobacteriaceae_bacterium_phI
gatcctggctcaggatgaacgctggcggcgcgcctaacacatgcaagtcgagcggcaccctgcttcggcaggaagcgagcggcgaacggctgagtaacacgtgaccaacctgccctgcgcacggggacagccgcgggaaaccgcgggtgatacccggtggccccggggggacgcatgtccccagcgggcatagctccggcggcgcgggatggggtcgcggcccatcaggtagttggtagggtgacggcctaccaagccgactacgggtagccgggttgagagaccgaccggccagattgggactgagacacggcccagactcctacgggaggcagcagtggggaatcttgcgcaatggggggaaccctgacgcagcgacgccgcgtgcgggatggaggccttcgggtcgtgaaccgctttcagcagggacgagactgacggtacctgcagaagaagccccggctaactacgtgccagcagccgcggtaatacgtagggggcgagcgttatccggattcattgggcgtaaagcgcgcgtaggcggccgcgcaggcggggggtcaaatcccggggctcaaccccgggccgccccccgaaccgcgcggcttgggtccggcaggggagggtggaacgcccggtgtagcggtggaatgcgcagatatcgggcggaacaccggtggcgaaggcggccctctgggccggcaccgacgctgaggcgcgagagccgggggagcgaacaggattagataccctggtagtcccggccgtaaacgatggacgctaggtgtggggacgttggagtctccgtgtgccgcagccaacgcattaagcgtcccgcctggggagtacggccgcaaggctaaaactcaaaggaattgacgggggcccgcacaagcagcggagcatgtggcttaattcgaagcaacgcgaagaaccttacccgcgcttgacatggcggtgaagcggcggagacgccgtggccgagaggagccgccacaggtggtgcatggctgtcgtcagctcgtgtcgtgagatgttgggttaagtcccgcaacgagcgcaacccccgccgcgtgttgccatcgggtgatgccgggaacccacgcgggaccgccgccgccaaggcggaggagggcggggacgacgtcaagtcatcatgccccttatgcgcggggctgcacacgtgctacaatggcaggtacagagggttgccaccccgcgagggggagcggatcccgaaagcctgccccagttcggaccgggggctgcaacccgcccccgcgaagtcggagttgctagtaatcgcggatcagcatgccgcggtgaatgcgttcccgggccttgtacacaccgcccgtcacaccacccgagtcgtctgcacccgaagccgccggcccaacctcgtgagggaggcgtcgaaggtgtggagggcgaggggggtgaagtcgtaacaaggtagccgta

SEQ ID NO: 210 - DNA, 1535 bp, Artificial Sequence
  Dorea_formicigenerans
ttttaaacgagagtttgatcctggctcaggatgaacgctggcggcgtgcttaacacatgcaagtcgagcgaagcacataagttcgattcttcggatgaagacttttgtgactgagcggcggacgggtgagtaacgcgtgggtaacctgcctcatacagggggataacagctagaaatggctgctaataccgcataagaccacagtactgcatggtacagtggtaaaaactccggtggtatgagatggacccgcgtctgattaggtagttggtgaggtaacggcccaccaagccgacgatcagtagccgacctgagagggtgaccggccacattgggactgagacacggcccagactcctacgggaggcagcagtggggaatattgcacaatgggcgaaagcctgatgcagcgacgccgcgtgaaggatgaagtatttcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggctgtgcaagtctgaagtgaaaggcatgggctcaacctgtggactgctttggaaactgtgcagctagagtgtcggagaggtaagtggaattcctagtgtagcggtgaaatgcgtagatattaggaggaacaccagtggcgaaggcggcttactggacgatgactgacgttgaggctcgaaagcgtggggagcaaacaggattagataccctggtagtccacgccgtaaacgatgactgctaggtgtcgggtagcaaagctattcggtgccgcagctaacgcaataagcagtccacctggggagtacgttcgcaagaatgaaactcaaaggaattgacggggacccgcacaagcggtggagcatgtggtttaattcgaagcaacgcgaagaaccttacctgatcttgacatcccgatgaccgcttcgtaatggaagcttttcttcggaacatcggtgacaggtggtgcatggttgtcgtcagctcgtgtcgtgagatgttgggttaagtcccgcaacgagcgcaacccttatcttcagtagccagcatttaggatgggcactctggagagactgccagggataacctggaggaaggtggggatgacgtcaaatcatcatgccccttatgaccagggctacacacgtgctacaatggcgtaaacaaagggaagcagagccgcgaggccgagcaaatctcaaaaataacgtctcagttcggattgtagtctgcaactcgactacatgaagctggaatcgctagtaatcgcagatcagaatgctgcggtgaatacgttcccgggtcttgtacacaccgcccgtcacaccatgggagtcagtaacgcccgaagtcagtgacccaaccgaaaggagggagctgccgaaggtgggaccgataactggggtgaagtcgtaacaaggtagccgtatcggaaggtgcggctggatcacctcctttct

SEQ ID NO: 211 - DNA, 1316 bp, Artificial Sequence
  Dorea_longicatena
taacgcgtgggtaacctgcctcatacagggggataacagttagaaatgactgctaataccgcataagaccacgtaccgcatggtacagtggtaaaaactccggtggtatgagatggacccgcgtctgattaggtagttggtggggtaacggcctaccaagccgacgatcagtagccgacctgagagggtgaccggccacattgggactgagacacggcccagactcctacgggaggcagcagtggggaatattgcacaatggaggaaactctgatgcagcgacgccgcgtgaaggatgaagtatttcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggcacggcaagccagatgtgaaaagcccggggctcaaccccgggactgcatttggaactgctgagctagagtgtcggagaggcaagtggaattcctagtgtagcggtgaaatgcgtagatattaggaggaacaccagtggcgaaggcggcttgctggacgatgactgacgttgaggctcgaaagcgtggggagcaaacaggattagataccctggtagtccacgccgtaaacgatgactgctaggtgtcgggtggcaaagccattcggtgccgcagctaacgcaataagcagtccacctggggagtacgttcgcaagaatgaaactcaaaggaattgacggggacccgcacaagcggtggagcatgtggtttaattcgaagcaacgcgaagaaccttacctgatcttgacatcccgatgaccgcttcgtaatggaagtttttcttcggaacatcggtgacaggtggtgcatggttgtcgtcagctcgtgtcgtgagatgttgggttaagtcccgcaacgagcgcaacccctatcttcagtagccagcaggttaagctgggcactctggagagactgccagggataacctggaggaaggtggggatgacgtcaaatcatcatgccccttatgaccagggctacacacgtgctacaatggcgtaaacaaagagaagcgaactcgcgagggtaagcaaatctcaaaaataacgtctcagttcggattgtagtctgcaactcgactacatgaagctggaatcgctagtaatcgcagatcagaatgctgcggtgaatacgttcccgggtcttgtacacaccgcccgtcacaccatgggagtcataacgcccgaagtcagtgacccaaccgtaagg

SEQ ID NO: 212 - DNA, 1505 bp, Artificial Sequence
  Eggerthella_sp_1_3_56FAA
gagagtttgatcctggctcaggatgaacgctggcggcgtgcctaacacatgcaagtcgaacgatgaaaccgccctcgggcggacatgaagtggcgaacgggtgagtaacacgtgaccaacctgcccccctctccgggacaaccttgggaaaccgaggctaataccggatactccctcccctgctcctgcaggggtcgggaaagcccaggcggagggggatggggtcgcggcccattaggtagtaggcggggtaacggcccacctagcccgcgatgggtagccgggttgagagaccgaccggccacattgggactgagatacggcccagactcctacgggaggcagcagtggggaattttgcgcaatgggggcaaccctgacgcagcaacgccgcgtgcgggacgacggccttcgggttgtaaaccgctttcagcagggaagaaattcgacggtacctgcagaagaagctccggctaactacgtgccagcagccgcggtaatacgtagggagcgagcgttatccggattcattgggcgtaaagagcgcgtaggcggcctctcaagcgggatctctaatccgagggctcaacccccggccggatcccgaactgggaggctcgagttcggtagaggcaggcggaattcccggtgtagcggtggaatgcgcagatatcgggaagaacaccgatggcgaaggcagcctgctgggccgcaactgacgctgaggcgcgaaagctaggggagcgaacaggattagataccctggtagtcctagccgtaaacgatggatactaggtgtggggggctccgccctccgtgccgcagccaacgcattaagtatcccgcctggggagtacggccgcaaggctaaaactcaaaggaattgacgggggcccgcacaagcagcggagcatgtggcttaattcgaagcaacgcgaagaaccttaccagggcttgacatggacgtgaagccggggaaacccggtggccgagaggagcgtccgcaggtggtgcatggctgtcgtcagctcgtgtcgtgagatgttgggttaagtcccgcaacgagcgcaacccctgccccatgttgccagcattaggttggggactcatgggggactgccggcgtcaagccggaggaaggtggggacgacgtcaagtcatcatgccctttatgccctgggctgcacacgtgctacaatggccggtacaacgggctgcgagaccgcgaggtcgagcgaatccctcaaagccggccccagttcggatcggaggctgcaacccgcctccgtgaagtcggagttgctagtaatcgcggatcagcatgccgcggtgaatacgttcccgggccttgtacacaccgcccgtcacaccacccgagtcgtctgcacccgaagccgccggccgaacccgcaaggggcggaggcgtcgaaggtgtggagggtaaggggggtgaagtcgtaacaaggtagccgtaccggaaggtgcggctggatcacctcctttct

SEQ ID NO: 213 - DNA, 1543 bp, Artificial Sequence
  Eremococcus_coleocola
atgagagtttgatcctggctcaggacgaacgctggcggcgtgcctaatacatgcaagtcgaacgcactgacggagaacttgttctcttaacgtgagtggcggacgggtgagtaacacgtgggaaacctacccttgagcgggggataacggtcggaaacgatcgctaataccgcataacagcaatcatcgcctgatggttgattgaaagatggctctgctatcactcaaggatgggcccgcggtgcattagctagttggtaaggtaacggcttaccaaggccatgatgcatagccgacctgagagggtaatcggccacattgggactgagacacggcccaaactcctacgggaggcagcagtagggaatcttccgcaatggacgcaagtctgacggagcaacgccgcgtgtgtgaagaaggttttcggatcgtaaagcactgttattagccaagaacacccctagtagtaactggctagggattgacggtaactaatcagaaagccacggctaactacgtgccagcagccgcggtaatacgtaggtggcaagcgttgtccggatttattgggcgtaaagggagcgcaggcggtgacttaagtctgatgtgaaagcccacggcttaaccgtggagggtcattggaaactgggtcacttgagtacagaagaggaaagcggaattccatgtgtagcggtgaaatgcgtagatatatggaggaacaccagtggcgaaggcggctttctggtctgatactgacgctgaggctcgaaagcgtggggagcaaacaggattagataccctggtagtccacgccgtaaacgatgagtgctaagtgttggagggtttccacccttcagtgctggcgttaacgcaataagcactccgcctggggagtacggtcgcaagactgaaactcaaaggaattgacggggacccgcacaagcggtggagcatgtggtttaattcgaagcaacgcgaagaaccttaccaggtcttgacatcctatgaccactctagagatagagtttctcttcggagcatagagacaggtggtgcatggttgtcgtcagctcgtgtcgtgagatgttgggttaagtcccgcaacgagcgcaacccttataactagttgccagcattcagatggggactctagttagactgccggtgacaaaccggaggaaggtggggatgacgtcaaatcatcatgccccttatgacctgggctacacacgtgctacaatggacgatacaacgagcagcaaactcgcgagggcaagcgaatctcttaaagtcgttctcagttcggattgcaggctgcaactcgcctgcatgaagccggaatcgctagtaatcgtggatcagcacgccacggtgaatccgttcccgggtcttgtacacaccgcccgtcacaccacgagagtttgtaacacccgaagccggtggcctaacctatgagggagccgtcgaaggtgggatagatgattggggtgaagtcgtaacaaggtagccgtatcggaaggtgcggctggatcacctcctttct

SEQ ID NO: 214 - DNA, 1542 bp, Artificial Sequence
  Erysipelotrichaceae_bacterium_3_1_ 53
tcaaatggagagtttgatcctggctcaggatgaacgctggcggcatgcctaatacatgcaagtcgaacgaagtctctaggagcttgcttccaaagagacttagtggcgaacgggtgagtaacacgtaggtaacctgcccatgtgtctgggataactgctggaaacggtagctaaaaccggataggtatacggagcgcatgctctgtatattaaagcacccctcaaggtgtgaacatggatggacctgcggcgcattagctagttggtgaggtaacggcccaccaaggcgatgatgcgtagccggcctgagagggtaaacggccacattgggactgagacacggcccaaactcctacgggaggcagcagtagggaattttcgtcaatggggggaaccctgaacgagcaatgccgcgtgagtgaagaaggtcttcggatcgtaaagctctgttgtaagtgaagaacggctcatagaggaaatgctatgggagtgacggtagcttaccagaaagccacggctaactacgtgccagcagccgcggtaatacgtaggtggcaagcgttatccggaatcattgggcgtaaagggtgcgtaggtggcgtactaagtctgtagtaaaaggcaatggctcaaccattgtaagctatggaaactggtaggctagagtgcagaagagggcgatggaattccatgtgtagcggtaaaatgcgtagatatatggaggaacaccagtggcgaaggcggtcgcctggtctgtaactgacactgaggcacgaaagcgtggggagcaaataggattagataccctagtagtccacgccgtaaacgatgagaactaagtgttggaggaattcagtgctgcagttaacgcaataagttctccgcctggggagtatgcacgcaagtgtgaaactcaaaggaattgacgggggcccgcacaagcggtggagtatgtggtttaattcgaagcaacgcgaagaaccttaccaggccttgacatggatgcaaaggctctagagatagagagataattatggatcacacaggtggtgcatggttgtcgtcagctcgtgtcgtgagatgttgggttaagtcccgcaacgagcgcaacccttgtcgcatgttaccagcatcaagttggggactcatgcgagactgccggtgacaaaccggaggaaggtggggatgacgtcaaatcatcatgccccttatggcctgggctacacacgtactacaatggcgaccacaaagagcagcgacttggtgacaaggagcgaatctcataaaggccgtctcagttcggattgaagtctgcaactcgacttcatgaagtcggaatcgctagtaatcgcagatcagcatgctgcggtgaatacgttctcgggccttgtacacaccgcccgtcaaaccatgggagtcagtaatacccgaagccggtggcataaccgtaaggagtgagccgtcgaaggtaggaccgatgactggggttaagtcgtaacaaggtatccctacgggaacgtggggatggatcacctcctttct

SEQ ID NO: 215 - DNA, 1527 bp, Artificial Sequence
  Eubacterium_barkeri
  misc_feature (617)..(618): n is a, c, g, or t
  misc_feature (1473)..(1473): n is a, c, g, or t
  misc_feature (1475)..(1479): n is a, c, g, or t
  misc_feature (1488)..(1493): n is a, c, g, or t
  misc_feature (1504)..(1512): n is a, c, g, or t
tttaattgagagtttgatcctggctcaggacgaacgctggcggtatgcttaacacatgcaagtcgaacgagaagctttttatggatccttcgggagaaataagagtggaaagtggcgaacgggtgagtaacgcgtgggtaacctgcctcatggaaaggaatagcctcgggaaactgggagtaaagccttatattattaagacatcgcatggtgttttaatgaaaactccggtgccatgagatggacccgcgtcccattagctagttggtgagataacagcccaccaaggcaacgatgggtaaccggtctgagagggcgaacggtcacactggaactgagacacggtccagactcctacgggaggcagcagtggggaatattgcgcaatgggggcaaccctgacgcagcaataccgcgtgagtgaagaaggttttcggatcgtaaaactcttttattggggaagaagaagtgacggtacccaatgaagaagtcccggctaactacgtgccagcagccgcggtaatacgtaggggacaagcgttgtccggaatcactgggcgtaaagggcgcgtaggcggttttataagtcagatgtgaaaggtaccggctcaaccggnnacgtgcatttgaaactgtaagacttgagtactggagaggcaagtggaattcctagtgtagcggtgaaatgcgtagatattaggaggaacaccggtggcgaaggcggcttgctggacagatactgacgctgaggtgcgaaagcgtggggagcgaacaggattagataccctggtagtccacgccgtaaacgatgatgactaggtgttggggaaactcagtgccgcagttaacacattaagtcatccgcctggggagtacgaccgcaaggttgaaactcaaaggaattgacggggacccgcacaagcagcggagcatgtggtttaattcgaagcaacgcgaagaaccttaccaggccttgacatcctctgaccatcctagagataggagatttccttcgggaacagagagacaggtggtgcatggttgtcgtcagctcgtgtcgtgagatgttgggttaagtcccgcaacgagcgcaacccttgcctttagttgccagcattaagttgggcactctaaagggactgccgtagacaatacggaggaaggtggggacgacgtcaaatcatcatgccccttatggcctgggctacacacgtgctacaatgggttgggacaaagggaagcgaagccgcgaggtgaagccaatcccataaaacaacccccagttcggattgcaggctgaaacccgcctgcatgaagttggagttgctagtaatcgcagatcagaatgctgcggtgaatgcgttcccgggtcttgtacacaccgcccgtcacaccacgagagttggcaacacccgaagccagtgagcgaaccgcaaggacgcagctgtcgaaggtggggtcagtaattggggngnnnnngtaacaagnnnnnngtatcggaagnnnnnnnnngatcacctcctttct

SEQ ID NO: 216 - DNA, 1474 bp, Artificial Sequence
  Eubacterium_callanderi
cgaacgctggcggtatgcttaacacatgcaagtcgaacgagaaagttttgaatgatccttcgggtgaaattagaactggaaagtggcgaacgggtgagtaacgcgtgggtaacctgccctatggaaaggaatagcctcgggaaactgggagtaaagccttatattatggttttgtcgcatggcaagatcatgaaaactccggtgccataggatggacccgcgtcccattagctagttggtgagataacagcccaccaaggcgacgatgggtaaccggtctgagagggcgaacggtcacactggaactgagacacggtccagactcctacgggaggcagcagtggggaatattgcgcaatgggggcaaccctgacgcagcaataccgcgtgagtgaagaaggttttcggatcgtaaagctctgttattggggaagaaaacatgacggtacccaatgaggaagtcccggctaactacgtgccagcagccgcggtaatacgtaggggacaagcgttgtccggaatgactgggcgtaaagggcgcgtaggcggtctattaagtctgatgtgaaaggtaccggctcaaccggtgaagtgcattggaaactggtagacttgagtattggagaggcaagtggaattcctagtgtagcggtgaaatgcgtagatattaggaggaacaccagtggcgaaggcggcttgctggacaaatactgacgctgaggtgcgaaagcgtggggagcgaacaggattagataccctggtagtccacgccgtaaacgatgaatgctaggtgttggggaaactcagtgccgcagttaacacaataagcattccgcctggggagtacgaccgcaaggttgaaactcaaaggaattgacggggacccgcacaagcagcggagcatgtggtttaattcgaagcaacgcgaagaaccttaccaggtcttgacatcctctgacgagcctagagataggaagtttccttcgggaacagagagacaggtggtgcatggttgtcgtcagctcgtgtcgtgagatgttgggttaagtcccgcaacgagcgcaacccctgcctttagttgccagcattaagttgggcactctagagggactgccgtagacaatacggaggaaggtggggatgacgtcaaatcatcatgccccttatgacctgggctacacacgtgctacaatggtctgaacagagggccgcgaagccgcgaggtgaagcaaatcccttaaaacagatcccagttcggattgcaggctgcaactcgcctgcatgaagttggagttgctagtaatcgcggatcagaatgccgcggtgaatgcgttcccgggtcttgtacacaccgcccgtcacaccacgagagttggcaacacccgaagcctgtgagagaaccgcaaggactcagcagtcgaaggtggggctagtaattggggtgaagtcgtaacaaggtagccgtatcggaagg

SEQ ID NO: 217 - DNA, 1524 bp, Artificial Sequence
  Eubacterium_contortum
tttgatcctggctcaggatgaacgctggcgacgtgcttaacacatgcaagtcgagcgaagcactttactttgatttcttcggaatgaaaggttttgtgactgagcggcggacgggtgagtaacgcgtgggtaacctgcctcatacagggggataacagttagaaatgactgctaataccgcataagaccacagtaccgcatggtacagtgggaaaaactccggtggtatgagatggacccgcgtctgattagctagttggtaaggtaacggcttaccaaggcgacgatcagtagccgacctgagagggtgaccggccacattgggactgagacacggcccaaactcctacgggaggcagcagtggggaatattgcacaatgggggaaaccctgatgcagcgacgccgcgtgaaggatgaagtatttcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggttatgtaagtctgatgtgaaaacccggggctcaaccccgggactgcattggaaactatgtaactagagtgtcggagaggtaagtggaattcctagtgtagcggtgaaatgcgtagatattaggaggaacaccagtggcgaaggcggcttactggacgatgactgacgttgaggctcgaaagcgtggggagcaaacaggattagataccctggtagtccacgccgtaaacgatgaatactaggtgtcgggtggcaaagccattcggtgccgcagcaaacgcaataagtattccacctggggagtacgttcgcaagaatgaaactcaaaggaattgacggggacccgcacaagcggtggagcatgtggtttaattcgaagcaacgcgaagaaccttacctgctcttgacatccccctgaccggcgtgtaatggtgcctttccttcgggacaggggagacaggtggtgcatggttgtcgtcagctcgtgtcgtgagatgttgggttaagtcccgcaacgagcgcaacccttatctttagtagccagcggtttggccgggcactctagagagactgccagggataacctggaggaaggtggggatgacgtcaaatcatcatgccccttatgagcagggctacacacgtgctacaatggcgtaaacaaagggaggcgaagccgtgaggtggagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagttggtaacgcccgaagtcagtgacccaaccgcaaggagggagctgccgagggtgggaccgataactggggtgaagtcgtaacaaggtagccgtatcggaaggtgcggctggatcacctcctttct

SEQ ID NO: 218 - DNA, 1487 bp, Artificial Sequence
  Eubacterium_dolichum
  misc_feature (1)..(1): n is a, c, g, or t
  misc_feature (183)..(183): n is a, c, g, or t
  misc_feature (348)..(348): n is a, c, g, or t
  misc_feature (932)..(932): n is a, c, g, or t
  misc_feature (936)..(936): n is a, c, g, or t
  misc_feature (971)..(971): n is a, c, g, or t
  misc_feature (1052)..(1052): n is a, c, g, or t
  misc_feature (1388)..(1388): n is a, c, g, or t
ncaaatggagagtttgatcctggctcaggatgaacgctggcggcatgcctaatacatgcaagtcgaacgaagtttttaggaaagcttgctttccaaaaagacttagtggcgaacgggtgagtaacacgtagataacctgcccatgtgcccgggataactgctggaaacggtagctaaaaccgnataggtggcttcgaggcatctcggagacattaaaatggctaaggccatgaacatggatggatctgcggcgcattagctagttggtgaggtaacggcccaccaaggcgacgatgcgtagccgacctgagagggtgaacggccacattgggactgagacacggcccnaactcctacgggaggcagcagtagggaattttcgtcaatggggggaaccctgaacgagcaatgccgcgtgagtgaagaaggtcttcggatcgtaaagctctgttgtaagagaaaaacggatcatgtagggaatgacatgatagtgatggtatcttaccagaaagccacggctaactacgtgccagcagccgcggtaatacgtaggtggcaagcgttatccggaatgattgggcgtaaagggtgcgtaggtggtacattaagtctgaagtaaaaggcagcagctcaactgctgttcgctttggaaactggtgaactagagtgcaggagagggcgatggaattccatgtgtagcggtaaaatgcgtagatatatggaggaacaccagtggcgaaggcggtcgcctggcctgtaactgacactgaggcacgaaagcgtggggagcaaataggattagataccctagtagtccacgccgtaaacgatgagaactaagtgttggagagattcagtgctgcagttaacgcaataagttctccgcctggggagtatgcacgcaagtgtgaaactcaaaggaattgacgggngccngcacaagcggtggagtatgtggtttaattcgaagnaacgcgaagaaccttaccaggccttgacatggatataaatgttctagagatagaaagatagctatatatcacacaggtggngcatggttgtcgtcagctcgtgtcgtgagatgttgggttaagtcccgcaacgagcgcaacccttgtcgcatgttaccaatattaagttagggactcatgtgagactgccggtgacaaaccggaggaaggtggggatgacgtcaaatcatcatgccccttatggcctgggctacacacgtactacaatggcgtctacaaagaggagcgacatggtgacatgaagcaaatctcataaagggcgtctcagttcggattggagtctgcaactcgactccatgaagtcggaatcgctagtaatcgcagatcagcatgctgcggtgaatacgttctcgggcnttgtacacaccgcccgtcaaaccatgggagtcagtaatacccgaagccggtggcataacctaagggagtgagccgtcgaaggtaggaccgatgactggg

SEQ ID NO: 219 - DNA, 1527 bp, Artificial Sequence
  Eubacterium_fissicatena
  misc_feature (238)..(239): n is a, c, g, or t
tttgatcctggctcaggatgaacgctggcggcgtgcttaacacatgcaagtcgagcgaagcactttactttgatttcttcggaatgaagagtgttgtgactgagcggcggacgggtgagtaacgcgtgggtaacctgcctcatacagggggataacagttagaaatgactgctaataccgcataagaccacagtaccgcatggtacagtgggaaaaactccggtggtatgagatgganncbrcccgcgtctgattagctagttggtaaggtaacggcttaccaaggcgacgatcagtagccgacctgagagggtgaccggccacattgggactgagacacggcccaaactcctacgggaggcagcagtggggaatattgcacaatgggggaaaccctgatgcagcgacgccgcgtgaaggatgaagtatttcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggttatgtaagtctgatgtgaaaacccggggctcaaccccgggactgcattggaaactatgtaactagagtgtcggagaggtaagtggaattcctagtgtagcggtgaaatgcgtagatattaggaggaacaccagtggcgaaggcggcttactggacgatcactgacgttgaggctcgaaagcgtggggagcaaacaggattagataccctggtagtccacgccgtaaacgatgaatactaggtgtcgggtggcaaagccattcggtgccgcagcaaacgcaataagtattccacctggggagtacgttcgcaagaatgaaactcaaaggaattgacggggacccgcacaagcggtggagcatgtggtttaattcgaagcaacgcgaagaaccttacctgctcttgacatcccactgaccggcacgtaatggtgccttcccttcggggcagtggagacaggtggtgcatggttgtcgtcagctcgtgtcgtgagatgttgggttaagtcccgcaacgagcgcaacccttatctttagtagccagcggtttggccgggcactctagagagactgccagggataacctggaggaaggtggggatgacgtcaaatcatcatgccccttatgagcagggctacacacgtgctacaatggcgtaaacaaagggaggcaataccgcgaggttgagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagttggtaacgcccgaagtcagtgacccaaccgtaaggagggagctgccgaaggcgggatcgataactggggtgaagtcgtaacaaggtagccgtatcggaaggtgcggctggatcacctccttt

SEQ ID NO: 220 - DNA, 1431 bp, Artificial Sequence
  Eubacterium_hallii
ggtgactgagtggcggacgggtgagtaacgcgtgggtaacctgccctgtacagggggataacagctggaaacggctgctaataccgcataagcgcacgaggagacatctccttgtgtgaaaaactccggtggtacaggatgggcccgcgtctgattagctggttggcagggtaacggcctaccaaggcaacgatcagtagccggtctgagaggatgaacggccacattggaactgagacacggtccaaactcctacgggaggcagcagtggggaatattgcacaatgggggaaaccctgatgcagcaacgccgcgtgagtgaagaagtatttcggtatgtaaagctctatcagcagggaagataatgacggtacctgactaagaagctccggctaaatacgtgccagcagccgcggtaatacgtatggagcaagcgttatccggatttactgggtgtaaagggtgcgtaggtggcagtgcaagtcagatgtgaaaggccggggctcaaccccggagctgcatttgaaactgctcggctagagtacaggagaggcaggcggaattcctagtgtagcggtgaaatgcgtagatattaggaggaacaccagtggcgaaggcggcctgctggactgttactgacactgaggcacgaaagcgtggggagcaaacaggattagataccctggtagtccacgccgtaaacgatgaatactaggtgtcggggccgtataggcttcggtgccgccgctaacgcagtaagtattccacctggggagtacgttcgcaagaatgaaactcaaaggaattgacggggacccgcacaagcggtggagcatgtggtttaattcgaagcaacgcgaagaaccttaccaggtcttgacatccttctgaccgcaccttaatcggtgctttccttcgggacagaagagacaggtggtgcatggttgtcgtcagctcgtgtcgtgagatgttgggttaagtcccgcaacgagcgcaacccctatcttcagtagccagcaggtaaggctgggcactctggagagactgccagggataacctggaggaaggtggggacgacgtcaaatcatcatgccccttatgatctgggcgacacacgtgctacaatggcggtcacagagtgaggcgaacccgcgagggggagcaaaccacaaaaaggccgtcccagttcggactgtagtctgcaacccgactacacgaagctggaatcgctagtaatcgcgaatcagaatgtcgcggtgaatacgttcccgggtcttgtacacaccgcccgtcacaccatgggagtcggaaatgcccgaagccagtgacccaaccttttggagggagctgtcgaaggtggagccggtaactggggtgaagtcgtaacaaggtagccgtatcggaaggtgcggctggatcacctcctttct

SEQ ID NO: 221 - DNA, 1473 bp, Artificial Sequence
  Eubacterium_hallii
  misc_feature (611)..(611): n is a, c, g, or t
  misc_feature (949)..(949): n is a, c, g, or t
  misc_feature (1081)..(1081): n is a, c, g, or t
  misc_feature (1092)..(1092): n is a, c, g, or t
  misc_feature (1178)..(1179): n is a, c, g, or t
  misc_feature (1221)..(1221): n is a, c, g, or t
  misc_feature (1253)..(1253): n is a, c, g, or t
  misc_feature (1263)..(1263): n is a, c, g, or t
  misc_feature (1368)..(1369): n is a, c, g, or t
  misc_feature (1385)..(1385): n is a, c, g, or t
tgagagtttgatcctggctcaggatgaacgctggcggcgtgcctaacacatgcaagtcgaacgaagcaccttaccwgattcttcggatgaaagwytggtgactgagtggcggacgggtgagtaacgcgtgggtaacctgccctgtacagggggataacagctggaaacggctgctaataccgcataagcgcacgaggagacatctccttgtgtgaaaaactccggtggtacaggatgggcccgcgtctgattagctggttggcagggtaacggcctaccaaggcaacgatcagtagccggtctgagaggatgaacggccacattggaactgagacacggtccaaactcctacgggaggcagcagtggggaatattgcacaatgggggaaaccctgatgcagcaacgccgcgtgagtgaagaagtatttcggtatgtaaagctctatcagcagggaagataatgacggtacctgactaagaagctccggctaaatacgtgccagcagccgcggtaatacgtatggagcaagcgttatccggatttactgggtgtaaagggtgcgtaggtggcagtgcaagtcagatgtgaaaggccggggctcaaccccggngctgcatttgaaactgcwyrgctagagtacaggagaggcaggcggaattcctagtgtagcggtgaaatgcgtagatattaggaggaacaccagtggcgaaggcggcctgctggactgttactgacactgaggcacgaaagcgtggggagcaaacaggattagataccctggtagtccacgccgtaaacgatgaatactaggtgtcggggccgtataggctycggtgccgccgctaacgcagtaagtattccacctggggagtacgttcgcaagaatgaaactcaaaggaattgacggggacccgcacaagcggtggagcatgtggtttaattcgaagnaacgcgaagaaccttaccaggtcttgacatccttctgaccgcaccttaatcggtgctttccttcgggacagaagagacaggtggtgcatggttgtcgtcagctcgtgtcgtgagatgttgggttaagtcccncaacgagcgcnacccctatcttcagtagccagcaggtaaggctgggcactctggagagactgccagggataacctggaggaaggtggggacgacgtnnaatcatcatgccccttatgatctgggcgacacacgtgctacnatggcggtcacagagtgaggcgaaccygcganggggagcaanccacaaaaaggccgtcccagttcggactgtagtctgcaacccgactacacgaagctggaatcgctagtaatcgcgaatcagaatgtcgcggtgaatacgttcccnngtcttgtacacaccgnccgtcacaccatgggagtcggaaatgcccgaagccagtgacccaacctttatggagggagctgtcgaaggtggagccggtaactgggg

SEQ ID NO: 222 - DNA, 1512 bp, Artificial Sequence
  Eubacterium_limosum
agagtttgatcctggctcaggacgaacgctggcggtatgcttaacacatgcaagtcgaacgagaaggttttgaatgatccttcgggtgaaattagaactggaaagtggcgaacgggtgagtaacgcgtgggtaacctgccctatggaaaggaatagcctcgggaaactgggagtaaagccttatattatggttttgtcgcatggcgagatcatgaaaactccggtgccataggatggacccgcgtcccattagctagttggtgagataacagcccaccaaggcgacgatgggtaaccggtctgagagggcgaacggtcacactggaactgagacacggtccagactcctacgggaggcagcagtggggaatattgcgcaatgggggcaaccctgacgcagcaataccgcgtgagtgaagaaggttttcggatcgtaaagctctgttattggggaagaaaacatgacggtacccaatgaggaagtcccggctaactacgtgccagcagccgcggtaatacgtaggggacaagcgttgtccggaatgactgggcgtaaagggcgcgtaggcggtctattaagtctgatgtgaaaggtaccggctcaaccggtgaagtgcattggaaactggtagacttgagtattggagaggcaagtggaattcctagtgtagcggtgaaatgcgtagatattaggaggaacaccagtggcgaaggcggcttgctggacaaatactgacgctgaggtgcgaaagcgtggggagcgaacaggattagataccctggtagtccacgccgtaaacgatgaatgctaggtgttggggaaactcagtgccgcagttaacacaataagcattccgcctggggagtacgaccgcaaggttgaaactcaaaggaattgacggggacccgcacaagcagcggagcatgtggtttaattcgaagcaacgcgaagaaccttaccaggtcttgacatcctctgacgagcctagagataggaagtttccttcgggaacagagagacaggtggtgcatggttgtcgtcagctcgtgtcgtgagatgttgggttaagtcccgcaacgagcgcaacccctgcctttagttgccagcattaagttgggcactctagagggactgccgtagacaatacggaggaaggtggggatgacgtcaaatcatcatgccccttatgacctgggctacacacgtgctacaatggtctgaacagagggccgcgaagccgcgaggtgaagcaaatcccttaaaacagatcccagttcggattgcaggctgcaactcgcctgcatgaagttggagttgctagtaatcgcggatcagaatgccgcggtgaatgcgttcccgggtcttgtacacaccgcccgtcacaccacgagagttggcaacacccgaagcctgtgagagaaccgcaaggactcagcagtcgaaggtggggctagtaattggggtgaagtcgtaacaaggtagccgtatcggaaggtgcggctggatcacct

SEQ ID NO: 223 - DNA, 1521 bp, Artificial Sequence
  Eubacterium_rectale
agagtttgatcctggctcaggatgaacgctggcggcgtgcttaacacatgcaagtcgaacgaagcactttatttgatttccttcgggactgattattttgtgactgagtggcggacgggtgagtaacgcgtgggtaacctgccttgtacagggggataacagttggaaacggctgctaataccgcataagcgcacagcatcgcatgatgcagtgtgaaaaactccggtggtataagatggacccgcgttggattagctagttggtgaggtaacggcccaccaaggcgacgatccatagccgacctgagagggtgaccggccacattgggactgagacacggcccaaactcctacgggaggcagcagtggggaatattgcacaatgggcgaaagcctgatgcagcgacgccgcgtgagcgaagaagtatttcggtatgtaaagctctatcagcagggaagataatgacggtacctgactaagaagcaccggctaaatacgtgccagcagccgcggtaatacgtatggtgcaagcgttatccggatttactgggtgtaaagggagcgcaggcggtgcggcaagtctgatgtgaaagcccggggctcaaccccggtactgcattggaaactgtcgtactagagtgtcggaggggtaagcggaattcctagtgtagcggtgaaatgcgtagatattaggaggaacaccagtggcgaaggcggcttactggacgataactgacgctgaggctcgaaagcgtggggagcaaacaggattagataccctggtagtccacgctgtaaacgatgaatactaggtgttgggaagcattgcttctcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatccttctgaccggtacttaaccgtaccttctcttcggagcaggagtgacaggtggtgcatggttgtcgtcagctcgtgtcgtgagatgttgggttaagtcccgcaacgagcgcaacccttatctttagtagccagcggtctggccgggcactctagagagactgccagggataacctggaggaaggcggggatgacgtcaaatcatcatgccccttatgacttgggctacacacgtgctacaatggcgtaaacaaagggaagcgaagctgtgaagccgagcaaatctcaaaaataacgtctcagttcggactgtagtctgcaacccgactacacgaagctggaatcgctagtaatcgcagatcagaatgctgcggtgaatacgttcccgggtcttgtacacaccgcccgtcacaccatgggagttgggaatgcccgaagccagtgacctaaccgaaaggaaggagctgtcgaaggcaggctcgataactggggtgaagtcgtaacaaggtagccgtatcggaaggtgcggctggatcacct

SEQ ID NO: 224 - DNA, 1537 bp, Artificial Sequence
  Eubacterium_rectale
tttaacatgagagtttgatcctggctcaggatgaacgctggcggcgtgcttaacacatgcaagtcgaacgaagcactttatttgatttccttcgggactgattattttgtgactgagtggcggacgggtgagtaacgcgtgggtaacctgccttgtacagggggataacagttggaaacggctgctaataccgcataagcgcacagcatcgcatgatgcagtgtgaaaaactccggtggtataagatggacccgcgttggattagctagttggtgaggtaacggcccaccaaggcgacgatccatagccgacctgagagggtgaccggccacattgggactgagacacggcccaaactcctacgggaggcagcagtggggaatattgcacaatgggcgaaagcctgatgcagcgacgccgcgtgagcgaagaagtatttcggtatgtaaagctctatcagcagggaagataatgacggtacctgactaagaagcaccggctaaatacgtgccagcagccgcggtaatacgtatggtgcaagcgttatccggatttactgggtgtaaagggagcgcaggcggtgcggcaagtctgatgtgaaagcccggggctcaaccccggtactgcattggaaactgtcgtactagagtgtcggaggggtaagcggaattcctagtgtagcggtgaaatgcgtagatattaggaggaacaccagtggcgaaggcggcttactggacgataactgacgctgaggctcgaaagcgtggggagcaaacaggattagataccctggtagtccacgccgtaaacgatgaatactaggtgttgggaagcattgcttctcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatccttctgaccggtacttaaccgtaccttctcttcggagcaggagtgacaggtggtgcatggttgtcgtcagctcgtgtcgtgagatgttgggttaagtcccgcaacgagcgcaacccttatctttagtagccagcggttcggccgggcactctagagagactgccagggataacctggaggaaggcggggatgacgtcaaatcatcatgccccttatgacttgggctacacacgtgctacaatggcgtaaacaaagggaagcaaagctgtgaagccgagcaaatctcaaaaataacgtctcagttcggactgtagtctgcaacccgactacacgaagctggaatcgctagtaatcgcagatcagaatgctgcggtgaatacgttcccgggtcttgtacacaccgcccgtcacaccatgggagttgggaatgcccgaagccagtgacctaaccgaaaggaaggagctgtcgaaggcaggctcgataactggggtgaagtcgtaacaaggtagccgtatcggaaggtgcggctggatcacctcctttct

SEQ ID NO: 225 - DNA, 1521 bp, Artificial Sequence
  Eubacterium_rectale
agagtttgatcctggctcaggatgaacgctggcggcgtgcttaacacatgcaagtcgaacgaagcactttatttgatttccttcgggactgattattttgtgactgagtggcggacgggtgagtaacgcgtgggtaacctgccttgtacagggggataacagttggaaacggctgctaataccgcataagcgcacagcatcgcatgatgcagtgtgaaaaactccggtggtataagatggacccgcgttggattagctagttggtgaggtaacggcccaccaaggcgacgatccatagccgacctgagagggtgaccggccacattgggactgagacacggcccaaactcctacgggaggcagcagtggggaatattgcacaatgggcgaaagcctgatgcagcgacgccgcgtgagcgaagaagtatttcggtatgtaaagctctatcagcagggaagataatgacggtacctgactaagaagcaccggctaaatacgtgccagcagccgcggtaatacgtatggtgcaagcgttatccggatttactgggtgtaaagggagcgcaggcggtgcggcaagtctgatgtgaaagcccggggctcaaccccggtactgcattggaaactgtcgtactagagtgtcggaggggtaagcggaattcctagtgtagcggtgaaatgcgtagatattaggaggaacaccagtggcgaaggcggcttactggacgataactgacgctgaggctcgaaagcgtggggagcaaacaggattagataccctggtagtccacgccgtaaacgatgaatactaggtgttgggaagcattgcttctcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatccttctgaccggtacttaaccgtaccttctcttcggagcaggagtgacaggtggtgcatggttgtcgtcagctcgtgtcgtgagatgttgggttaagtcccgcaacgagcgcaacccttatctttagtagccagcggttcggccgggcactctagagagactgccagggataacctggaggaaggcggggatgacgtcaaatcatcatgccccttatgacttgggctacacacgtgctacaatggcgtaaacaaagggaagcaaagctgtgaagccgagcaaatctcaaaaataacgtctcagttcggactgtagtctgcaacccgactacacgaagctggaatcgctagtaatcgcagatcagaatgctgcggtgaatacgttcccgggtcttgtacacaccgcccgtcacaccatgggagttgggaatgcccgaagccagtgacctaaccgaaaggaaggagctgtcgaaggcaggctcgataactggggtgaagtcgtaacaaggtagccgtatcggaaggtgcggctggatcacct

SEQ ID NO: 226 - DNA, 1496 bp, Artificial Sequence
  Eubacterium_rectale
agtttgatcctggctcaggatgaacgctggcggcgtgcttaacacatgcaagtcgaacgaaggcacttctatatgatttccttcgggactgattattttgtgactgagtggcggacgggtgagtaacgcgtgggtaacctgccttgtacagggggataacagttggaaacggctgctaataccgcataagcgcacggcatcgcatgatgcagtgtgaaaaactccggtggtataagatggacccgcgttggattagctagttggtgaggtaacggcccaccaaggcgacgatccatagccgacctgagagggtgaccggccacattgggactgagacacggcccaaactcctacgggaggcagcagtggggaatattgcacaatgggcgaaagcctgatgcagcgacgccgcgtgagcgaagaagtatttcggtatgtaaagctctatcagcagggaagataatgacggtacctgactaagaagcaccggctaaatacgtgccagcagccgcggtaatacgtatggtgcaagcgttatccggatttactgggtgtaaagggagcgcaggcggtgcggcaagtctgatgtgaaagcccggggctcaaccccggtactgcattggaaactgtcgtactagagtgtcggaggggtaagcggaattcctagtgtagcggtgaaatgcgtagatattaggaggaacaccagtggcgaaggcggcttactggacgataactgacgctgaggctcgaaagcgtggggagcaaacaggattagataccctggtagtccacgccgtaaacgatgaatactaggtgttgggaagcattgcttctcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatccttctgaccggtacttaaccgtaccttctcttcggagcaggagtgacaggtggtgcatggttgtcgtcagctcgtgtcgtgagatgttgggttaagtcccgcaacgagcgcaacccttatctttagtagccagcggttcggccgggcactctagagagactgccagggataacctggaggaaggcggggatgacgtcaaatcatcatgccccttatgacttgggctacacacgtgctacaatggcgtaaacaaagggaagcaaagctgtgaagccgagcaaatctcaaaaataacgtctcagttcggactgtagtctgcaacccgactacacgaagctggaatcgctagtaatcgcagatcagaatgctgcggtgaatacgttcccgggtcttgtacacaccgcccgtcacaccatgggagttgggaatgcccgaagccagtgacctaaccgaaaggaaggagctgtcgaaggcaggctcgataactggggtgaagtcgtaacaaggtagccgt

SEQ ID NO: 227 - DNA, 1526 bp, Artificial Sequence
  Eubacterium_sp_3_1_31
agagtttgatcctggctcaggatgaacgctggcggcatgcctaatacatgcaagtcgaacgaagtctttaggaagcttgcttccaaagagacttagtggcgaacgggtgagtaacacgtaggtaacctgcccatgtgcccgggataactgctggaaacggtagctaaaaccggataggtatgagggaggcatcttcctcatattaaagcaccttcgggtgtgaacatggatggacctgcggcgcattagctggttggtgaggtaacggcccaccaaggcgatgatgcgtagccgacctgagagggtgaacggccacattgggactgagacacggcccaaactcctacgggaggcagcagtagggaattttcgtcaatggggggaaccctgaacgagcaatgccgcgtgtgtgaagaaggtcttcggatcgtaaagcactgttgtaagtgaagaatgccacatagaggaaatgctatgtgggtgacggtagcttaccagaaagccacggctaactacgtgccagcagccgcggtaatacgtaggtggcaagcgttatccggaatcattgggcgtaaagggtgcgtaggtggcacgataagtctgaagtaaaaggcaacagctcaactgttgtatgctttggaaactgtcgagctagagtgcagaagagggcgatggaattccatgtgtagcggtaaaatgcgtagatatatggaggaacaccagtggcgaaggcggtcgcctggtctgtaactgacactgatgcacgaaagcgtggggagcaaataggattagataccctagtagtccacgccgtaaacgatgagaactaagtgttggagagattcagtgctgcagttaacgcaataagttctccgcctggggagtatgcacgcaagtgtgaaactcaaaggaattgacgggggcccgcacaagcggtggagtatgtggtttaattcgaagcaacgcgaagaaccttaccaggccttgacatggatataaatgttctagagatagaaagatagctatatatcacacaggtggtgcatggttgtcgtcagctcgtgtcgtgagatgttgggttaagtcccgcaacgagcgcaacccttgtcttctgttaccagcattaagttggggactcaggagagactgccggtgacaaaccggaggaaggtggggatgacgtcaaatcatcatgccccttatggcctgggctacacacgtactacaatggcgcctacaaagagcagcgacaccgcgaggtgaagcgaatctcataaagggcgtctcagttcggattgaagtctgcaactcgacttcatgaagtcggaatcgctagtaatcgcagatcagcatgctgcggtgaatacgttctcgggccttgtacacaccgcccgtcaaaccatgggagttggtaatacccgaagccggtggcataaccgcaaggagtgagccgtcgaaggtaggaccgatgactggggttaagtcgtaacaaggtatccctacgggaacgtggggatggatcacct

SEQ ID NO: 228 - DNA, 1363 bp, Artificial Sequence
  Eubacterium_sp_oral_clone_GI038
gagtttgattctggctcaggatgaacgctggcggcgtgcctaacacatgcaagtcgaacgagtggcggacgggtgagtaacgcgtgggcaacctgccccataccgggggatagcagttggaaacggctggtaaaaccgcataagaaaaagtggtatgggatgggcccgcgtctgattagccagttggtgaggtaacggctcaccaaagcgacgatcagtagccggcctgagagggcggacggccacattgggactgagacacggcccagactcctacgggaggcagcagtgggggatattgcacaatggaggaaactctgatgcagcgacgccgcgtgagtgaagaagtatttcggtatgtaaagctctatcagcagggaagatgacggtacctgagtaagaagctccggctaaatacgtgccagcagccgcggtaatacgtatggagcaagcgttatccggatttactgggtgtaaagggagcgcagacggatatgcaagtctgaagtgaaaccccacggctcaaccgtgggcttgctttggaaactgtagatctagagtactggagaggtaagcggaattcctggtgtagcggtgaaatgcgtagatatcaggaagaacatcggcggcgaaggcggcttactggacagactgacgttgaggctcgaaggcgtggggagcaaacaggattagataccctggtagcccacgcggtaaacgatgaatactaggtgttgggatttcagtgccgaagcaaacgtgataagtattccacctggggagtacgttcgcaagaatgaaactcaaaggaattgacggggacccgcacaagcggtggagcatgtggtttaattcgaagcaacgcgaagaaccttaccagaccttgaatcgacaggtggtgcatggttgtcgtcagctcgtgtcgtgagatgttgggttaagtcccgcaacgagcgcaacccttgcgtatagtagccagcaattgggaactctatacggactgccggggataacccggaggaaggtggggatgacgtcaaatcatcatgccccttatggtctgggctacacacgtgctacaatgtcgcagagggaagcgaaagggtgacctgaagcgaatctcaaaacgacccagttcggatgcaggctgcaacccgcctgcagaagctggaatcgctagtaatcgcgaatcagcatgtcgcggtgaatacgttcccgggtcttgtacacaccgcccgtcacaccatgggagtcgggaatgcccgaagccggtacctaaggagccgtcgaaggcaggccggatgactggggtgaagtcgtaacaaggtagccgtaggagaacctgcggctggaacacctcctt

SEQ ID NO: 229 - DNA, 1492 bp, Artificial Sequence
  Eubacterium_sp_WAL_14571
tagaagtttgtatttctgctcaggatgacgctggcggcgtgcttaacacatgcaagttcgagcgagaagcccattgactgaaaccttccggtagaagggattatggtggaaagcggcggacggggtgagtaacgcgtagccaacttgccctttacagagggatagccattggaaacgatgattaaaacctcataacgctcccccycacatggaggggaagccaaagattcatcggtaagggatgggcctgcgtctgattagcttgttggcggggtaacggcccaccaaggcgacgatcagtagccgacctgagagggtgatcggccacattggaactgagacacggtccaaactcctacgggaggcagcagtggggaatattgcacaatgggcgaaagcctgatgcagcaacgccgcgtgagggatgaaggccttcgggtcgtaaacctctgtccttggggaagaaacaaatgacggtacccatggaggaagccccggctaactacgtgccagcagccgcggtaatacgtagggggcgagcgttatccggaattattgggcgtaaagagtgcgtaggtggttacctaagcgcagggtctaaggcaatggctcaaccattgttcgccctgcgaactgggctacttgagtgcaggagaggaaagcggaattcctagtgtagcggtgaaatgcgtagatattaggaggaacaccagtggcgaaggcggctttctggactgttactgacactgaggcacgaaagcgtggggagcaaacaggattagataccctggtagtccacgccgtaaacgatgagcactaggtgtcggggccgcaaggcttcggtgccgcagttaacgcattaagtgctccgcctggggagtacgcacgcaagtgtgaaactcaaaggaattgacggggacccgcacaagcagcggagcatgtggtttaattcgaagcaacgcgaagaaccttaccaggacttgacatcccactgacagatccctaaccggatccttcttcggacagtggagacaggtggtgcatggttgtcgtcagctcgtgtcgtgagatgttgggttaagtcccgcaacgagcgcaacccttgccattagttgccatcattcagttgggcactctaatgggactgccggggacaactcggaggaaggtggggatgacgtcaaatcatcatgccccttatgttctgggctacacacgtgctacaatggccggtacagcaagaagcaaaaccgcgaggtggagcaaatctcaaaaaccggtcccagttcggactgcaggctgaaacccgcctgcacgaagccggagttgctagtaatcgtggatcagaatgccacggtgaatgcgttcccgggtcttgtacacaccgcccgtcacaccatggaagttgggggtgcccgaagccggcagggaaatatgctgtctaaggcaaaaccaatgactggggtgaagtcgtaacaaggttaaccgtaaa

SEQ ID NO: 230 - DNA, 1509 bp, Artificial Sequence
  Eubacterium_tenue
  misc_feature (33)..(33): n is a, c, g, or t
  misc_feature (70)..(88): n is a, c, g, or t
  misc_feature (177)..(177): n is a, c, g, or t
  misc_feature (511)..(512): n is a, c, g, or t
  misc_feature (1450)..(1450): n is a, c, g, or t
  misc_feature (1455)..(1461): n is a, c, g, or t
  misc_feature (1470)..(1475): n is a, c, g, or t
  misc_feature (1486)..(1494): n is a, c, g, or t
ttttatttgagagtttgatcctggctcaggatnaacgctggcggcgtgcctaacacatgcaagtcgagcnnnnnnnnnnnnnnnnnnnagcggcggacgggtgagtaacgcgtgggtaacctgccctgtacacacggataacataccgaaaggtatgctaatacgagatgatatatnaaagttgcatgacttttatatcaaagcttttgcggtacaggatggacccgcgtctgattagctagttggtaaggtaacggcttaccaaggcgacgatcagtagccgacctgagagggtgatcggccacactggaactgagacacggtccagactcctacgggaggcagcagtggggaatattgcacaatgggcgaaagcctgatgcagcaacgccgcgtgagcgatgaaggccttcgggtcgtaaagctctgtcctcaaggaagataatgacggtacttgaggaggaagccccggctaactacgtgccagcagccgcggtaatacgtagggggnnagcgttatccggaattactgggcgtaaagggtgcgtaggcggtctttcaagccagaagtgaaaggctacggctcaaccgtagtaagcttttggaactgtaagacttgagtgcaggagaggagagtggaattcctagtgtagcggtgaaatgcgtagatattaggaggaacaccagtagcgaaggcggctctctggactgtaactgacgctgaggcacgaaagcgtggggagcaaacaggattagataccctggtagtccacgccgtaaacgatgagtactaggtgtcgggggttacccccctcggtgccgcagctaacgcattaagtactccgcctgggaagtacgctcgcaagagtgaaactcaaaggaattgacggggacccgcacaagtagcggagcatgtggtttaattcgaagcaacgcgaagaaccttacctaagcttgacatcccattgacctctccctaatcggagatttcccttcggggacagtggtgacaggtggtgcatggttgtcgtcagctcgtgtcgtgagatgttgggttaagtcccgcaacgagcgcaacccttgcctttagttgccagcattaagttgggcactctagagggactgccgaggataactcggaggaaggtggggatgacgtcaaatcatcatgccccttatgcttagggctacacacgtgctacaatgggtggtacagagggttgccaaaccgtgaggtggagctaatcccttaaagccattctcagttcggattgtaggctgaaactcgcctacatgaagctggagttactagtaatcgcagatcagaatgctgcggtgaatgcgttcccgggtcttgtacacaccgcccgtcacaccatgggagttgggggcgcccgaagccggttagctaaccttttggaagcggccgtcgaaggtgaaaccaatgacnggggnnnnnnngtaacaagnnnnnngtatcggaagnnnnnnnnngatcacctcctttct

SEQ ID NO: 231 - DNA, 1505 bp, Artificial Sequence
  Facklamia_hominis
  misc_feature (344)..(344): n is a, c, g, or t
  misc_feature (364)..(365): n is a, c, g, or t
  misc_feature (638)..(638): n is a, c, g, or t
  misc_feature (652)..(652): n is a, c, g, or t
cgaacgctggcggcgtgcctaatacatgcaagtcgaacgaacggagctaggaactgaacccggcaaagttagtggcgcacgggtgagtaacacgtggagaacctacccttttgcgggggataaccattggaaacgatgactaataccgcatagaatcgcagatcgcatgatcaacgaaggaaagacggcttcggctgtcgcaaaaggatggctccgcggtgcattagctagatggtggggtaacggcctaccatggcaatgatgcatagccgacctgagagggtgatcggccacattgggactgagacacggcccaaactcctacgggaggcagcagtagggantcttccgcaatgggcgcaannctgacggagcaacgccgcgtgtgtgaagaaggtcttcggatcgtaaagcactgttgttagagaagaacgaccgctagagtaactgttagcggagtgacggtatctaaccagaaagccacggctaactacgtgccagcagccgcggtaatacgtaggtggcaagcgttgtccggatttattgggcgtaaagggagcgcaggcggtgacttaagtctgatgtgaaagcccacggctcaaccgtggagggtcattggaaactgggtcacttgagtncagaagaggaaagnggaattccatgtgtagcggtgaaatgcgtagatatatggaggaacaccagtggcgaaggcgactttctggtctgtaactgacgctgaggctcgaaagcgtggggagcaaacaggattagataccctggtagtccacgccgtaaacgatgagtgctaagtgttggagggtttccacccttcagtgctggagttaacgcaataagcactccgcctggggagtacggccgcaaggctgaaactcaaaggaattgacggggacccgcacaagcggtggagcatgtggtttaattcgaagcaacgcgaagaaccttaccaggtcttgacatctcttgcatagcctagagataggtgaagcccttcggggcaagaagacaggtggtgcatggttgtcgtcagctcgtgtcgtgagatgttgggttaagtcccgcaacgagcgcaacccttatcactagttgccagcattcagatggggactctagtgagactgccggtgacaaaccggaggaaggtggggatgacgtcaaatcatcatgccccttatgacctgggctacacacgtgctacaatggatggtacaacgagcagcgaactcgcaagggcaagcgaatctcttaaagccattctcagttcggattgttctctgcaactcgagaacatgaagccggaatcgctagtaatcgcggatcagcacgccgcggtgaatacgttcccgggtcttgtacacaccgcccgtcacaccacgagagtttgtaacacccgaagccggtggcctaactttatgaagccgtcgaaggtgggacagatgattggggtgaagtcgtaacaaggtagccgtatcggaaggtgcggctgg

SEQ ID NO: 232 - DNA, 1465 bp, Artificial Sequence
  Flavonifractor_plautii
cgctggcggcgtgcttaacacatgcaagtcgaacggggtgctcatgacggaggattcgtccaatggattgagttacctagtggcggacgggtgagtaacgcgtgaggaacctgccttggagaggggaataacactccgaaaggagtgctaataccgcatgaagcagttgggtcgcatggctctgactgccaaagatttatcgctctgagatggcctcgcgtctgattagctagtaggcggggtaacggcccacctaggcgacgatcagtagccggactgagaggttgaccggccacattgggactgagacacggcccagactcctacgggaggcagcagtggggaatattgggcaatgggcgcaagcctgacccagcaacgccgcgtgaaggaagaaggctttcgggttgtaaacttcttttgtcggggacgaaacaaatgacggtacccgacgaataagccacggctaactacgtgccagcagccgcggtaatacgtaggtggcaagcgttatccggatttactgggtgtaaagggcgtgtaggcgggattgcaagtcagatgtgaaaactgggggctcaacctccagcctgcatttgaaactgtagttcttgagtgctggagaggcaatcggaattccgtgtgtagcggtgaaatgcgtagatatacggaggaacaccagtggcgaaggcggattgctggacagtaactgacgctgaggcgcgaaagcgtggggagcaaacaggattagataccctggtagtccacgccgtaaacgatggatactaggtgtggggggtctgaccccctccgtgccgcagttaacacaataagtatcccacctggggagtacgatcgcaaggttgaaactcaaaggaattgacgggggcccgcacaagcggtggagtatgtggtttaattcgaagcaacgcgaagaaccttaccagggcttgacatcccactaacgaggcagagatgcgttaggtgcccttcggggaaagtggagacaggtggtgcatggttgtcgtcagctcgtgtcgtgagatgttgggttaagtcccgcaacgagcgcaacccttattgttagttgctacgcaagagcactctagcgagactgccgttgacaaaacggaggaaggtggggacgacgtcaaatcatcatgccccttatgtcctgggccacacacgtactacaatggtggttaacagagggaggcaataccgcgaggtggagcaaatccctaaaagccatcccagttcggattgcaggctgaaacccgcctgtatgaagttggaatcgctagtaatcgcggatcagcatgccgcggtgaatacgttcccgggccttgtacacaccgcccgtcacaccatgagagtcgggaacacccgaagtccgtagcctaaccgcaaggagggcgcggccgaaggtgggttcgataattggggtgaagtcgtaacaaggtag

SEQ ID NO: 233 - DNA, 1460 bp, Artificial Sequence
  Flavonifractor_plautii
gcgtgcttaacacatgcaagtcgaacggggtgctcatgacggaggattcgtccaacggattgagttacctagtggcggacgggtgagtaacgcgtgaggaacctgccttggagaggggaataacactccgaaaggagtgctaataccgcatgatgcagttgggtcgcatggctctgactgccaaagatttatcgctctgagatggcctcgcgtctgattagctagtaggcggggtaacggcccacctaggcgacgatcagtagccggactgagaggttgaccggccacattgggactgagacacggcccagactcctacgggaggcagcagtggggaatattgggcaatgggcgcaagcctgacccagcaacgccgcgtgaaggaagaaggctttcgggttgtaaacttcttttgtcggggacgaaacaaatgacggtacccgacgaataagccacggctaactacgtgccagcagccgcggtaatacgtaggtggcaagcgttatccggatttactgggtgtaaagggcgtgtaggcgggattgcaagtcagatgtgaaaactgggggctcaacctccagcctgcatttgaaactgtagttcttgagtgctggagaggcaatcggaattccgtgtgtagcggtgaaatgcgtagatatacggaggaacaccagtggcgaaggcggattgctggacagtaactgacgctgaggcgcgaaagcgtggggagcaaacaggattagataccctggtagtccacgccgtaaacgatggatactaggtgtggggggtctgaccccctccgtgccgcagttaacacaataagtatcccacctggggagtacgatcgcaaggttgaaactcaaaggaattgacgggggcccgcacaagcggtggagtatgtggtttaattcgaagcaacgcgaagaaccttaccagggcttgacatcccactaacgaagcagagatgcattaggtgcccttcggggaaagtggagacaggtggtgcatggttgtcgtcagctcgtgtcgtgagatgttgggttaagtcccgcaacgagcgcaacccttattgttagttgctacgcaagagcactctagcgagactgccgttgacaaaacggaggaaggtggggacgacgtcaaatcatcatgccccttatgtcctgggccacacacgtactacaatggtggttaacagagggaggcaataccgcgaggtggagcaaatccctaaaagccatcccagttcggattgcaggctgaaacccgcctgtatgaagttggaatcgctagtaatcgcggatcagcatgccgcggtgaatacgttcccgggccttgtacacaccgcccgtcacaccatgagagtcgggaacacccgaagtccgtagcctaaccgcaaggagggcgcggccgaaggtgggttcgataattggggtgaagtcgtaacaaggtagccg

SEQ ID NO: 234 - DNA, 1535 bp, Artificial Sequence
  Gardnerella_vaginalis
ttttcgtggagggttcgattctggctcaggatgaacgctggcggcgtgcttaacacatgcaagtcgaacgggatctgaccagcttgctggttggtgagagtggcgaacgggtgagtaatgcgtgaccaacctgccccatgctccagaatagctcttggaaacgggtggtaatgctggatgctccaacttgacgcatgtcttgttgggaaagtgtttagtggcatgggatggggtcgcgtcctatcagcttgtaggcggggtaatggcccacctaggcttcgacgggtagccggcctgagagggcggacggccacattgggactgagatacggcccagactcctacgggaggcagcagtggggaatattgcgcaatgggggaaaccctgacgcagcgacgccgcgtgcgggatgaaggccttcgggttgtaaaccgcttttgattgggagcaagctttcgggtgagtgtacctttcgaataagcgccggctaactacgtgccagcagccgcggtaatacgtagggcgcaagcgttatccggaattattgggcgtaaagagcttgtaggcggttcgtcgcgtctggtgtgaaagcccatcgcttaacggtgggtctgcgccgggtacgggcgggctagagtgcagtaggggagactggaattcccggtgtaacggtggaatgtgtagatatcgggaagaacaccaatggcgaaggcaggtctctgggctgttactgacgctgagaagcgaaagcgtggggagcgaacaggattagataccctggtagtccacgccgtaaacggtggacgctggatgtggggcccattccacgggttccgtgtcggagctaacgcgttaagcgtcccgcctggggagtacggccgcaaggctaaaactcaaagaaattgacgggggcccgcacaagcggcggagcatgcggattaattcgatgcaacgcgaagaaccttacctgggcttgacatgtgcctgtcgactgcagagatgtggtttcccttcggggcaggttcacaggtggtgcatggtcgtcgtcagctcgtgtcgtgagatgttgggttaagtcccgcaacgagcgcaaccctcgccctgtgttgccagcgggttatgccgggaactcacgggggaccgccggggttaactcggaggaaggtggggatgacgtcagatcatcatgccccttacgtccagggcttcacgcatgctacaatggccggtacaacgggatgcgacatggtgacatggagcggatcccttaaaaccggtctcagttcggatcgtagtctgcaactcgactacgtgaaggcggagtcgctagtaatcgcgaatcagcaacgtcgcggtgaatgcgttcccgggccttgtacacaccgcccgtcaagtcatgaaagtgggcagcacccgaagccggtggcctaacccttttgggatggagccgtctaaggtgaggctcgtgattgggactaagtcgtaacaaggtagccgtaccggaaggtgcggctggatcacctcctttctacgg

SEQ ID NO: 235 - DNA, 1527 bp, Artificial Sequence
  Gardnerella_vaginalis
cgtggagggttcgattctggctcaggatgaacgctggcggcgtgcttaacacatgcaagtcgaacgggatctagtcagcttgctgactggtgagagtggcgaacgggtgagtaatgcgtgaccaacctgccccatgctccagaatagctcttggaaacgggtggtaatgctggatgctccaacttgacgcatgtcttgttgggaaagtgtttagtggcatgggatggggtcgcgtcctatcagcttgtaggcggggtaatggcccacctaggcttcgacgggtagccggcctgagagggcggacggccacattgggactgagatacggcccagactcctacgggaggcagcagtggggaatattgcgcaatgggggaaaccctgacgcagcgacgccgcgtgcgggatgaaggccttcgggttgtaaaccgcttttgattgggagcaagccttcgggtgagtgtacctttcgaataagcgccggctaactacgtgccagcagccgcggtaatacgtagggcgcaagcgttatccggaattattgggcgtaaagagcttgtaggcggttcgtcgcgtctggtgtgaaagcccatcgcttaacggtgggtctgcgccgggtacgggcgggctagagtgcagtaggggagactggaattcccggtgtaacggtggaatgtgtagatatcgggaagaacaccaatggcgaaggcaggtctctgggctgttactgacgctgagaagcgaaagcgtggggagcgaacaggattagataccctggtagtccacgccgtaaacggtggacgctggatgtggggcccattccacgggttccgtgtcggagctaacgcgttaagcgtcccgcctggggagtacggccgcaaggctaaaactcaaagaaattgacgggggcccgcacaagcggcggagcatgcggattaattcgatgcaacgcgaagaaccttacctgggcttgacatgtgcctgtcgactgcagagatgtggtttcccttcggggcaggttcacaggtggtgcatggtcgtcgtcagctcgtgtcgtgagatgttgggttaagtcccgcaacgagcgcaaccctcgccctgtgttgccagcgggttatgccgggaactcacgggggaccgccggggttaactcggaggaaggtggggatgacgtcagatcatcatgccccttacgtccagggcttcacgcatgctacaatggccggtacaacgggatgcgacatggtgacatggagcggatcccttaaaaccggtctcagttcggatcgtagtctgcaactcgactacgtgaaggcggagtcgctagtaatcgcgaatcagcaacgtcgcggtgaatgcgttcccgggccttgtacacaccgcccgtcaagtcatgaaagtgggcagcacccgaagccggtggcctaacccttttgggatggagccgtctaaggtgaggctcgtgattgggactaagtcgtaacaaggtagccgtaccggaaggtgcggctggatcacctcctttct

SEQ ID NO: 236 - DNA, 1532 bp, Artificial Sequence
  Gardnerella_vaginalis
ttttcgtggagggttcgattctggctcaggatgaacgctggcggcgtgcttaacacatgcaagtcgaacgggatctgaccagcttgctggttggtgagagtggcgaacgggtgagtaatgcgtgaccaacctgccccatgctccagaatagctcttggaaacgggtggtaatgctggatgctccaacttgacgcatgtcttgttgggaaagtgtttagtggcatgggatggggtcgcgtcctatcagcttgtaggcggggtaatggcccacctaggcttcgacgggtagccggcctgagagggcggacggccacattgggactgagatacggcccagactcctacgggaggcagcagtggggaatattgcgcaatgggggaaaccctgacgcagcgacgccgcgtgcgggatgaaggccttcgggttgtaaaccgcttttgattgggagcaagccttttgggtgagtgtacctttcgaataagcgccggctaactacgtgccagcagccgcggtaatacgtagggcgcaagcgttatccggaattattgggcgtaaagagcttgtaggcggttcgtcgcgtctggtgtgaaagcccatcgcttaacggtgggtttgcgccgggtacgggcgggctagagtgcagtaggggagactggaattctcggtgtaacggtggaatgtgtagatatcgggaagaacaccaatggcgaaggcaggtctctgggctgttactgacgctgagaagcgaaagcgtggggagcgaacaggattagataccctggtagtccacgccgtaaacggtggacgctggatgtggggcccattccacgggttctgtgtcggagctaacgcgttaagcgtcccgcctggggagtacggccgcaaggctaaaactcaaagaaattgacgggggcccgcacaagcggcggagcatgcggattaattcgatgcaacgcgaagaaccttacctgggcttgacatgtgcctgacgactgcagagatgtggtttcctttcggggcaggttcacaggtggtgcatggtcgtcgtcagctcgtgtcgtgagatgttgggttaagtcccgcaacgagcgcaaccctcgccctgtgttgccagcgggttatgccgggaactcacgggggaccgccggggttaactcggaggaaggtggggatgacgtcagatcatcatgccccttacgtccagggcttcacgcatgctacaatggccagtacaacgggttgcttcatggtgacatggtgctaatcccttaaaactggtctcagttcggatcgtagtctgcaactcgactacgtgaaggcggagtcgctagtaatcgcgaatcagcaacgtcgcggtgaatgcgttcccgggccttgtacacaccgcccgtcaagtcatgaaagtgggcagcacccgaagccggtggcctaacccttttgggatggagccgtctaaggtgaggctcgtgattgggactaagtcgtaacaaggtagccgtaccggaaggtgcggctggatcacctcctttct

SEQ ID NO: 237 - DNA, 1315 bp, Artificial Sequence
  Gardnerella_vaginalis
ccagcttgctggttggtgagagtggcgaacgggtgagtaatgcgtgaccaacctgccccatgctccagaatagctcttggaaacgggtggtaatgctggatgctccaacttgacgcatgtcttgttgggaaagtgtttagtggcatgggatggggtcgcgtcctatcagcttgtaggcggggtaatggcccacctaggcttcgacgggtagccggcctgagagggcggacggccacattgggactgagatacggcccagactcctacgggaggcagcagtggggaatattgcgcaatgggggaaaccctgacgcagcgacgccgcgtgcgggatgaaggccttcgggttgtaaaccgcttttgattgggagcaagctttcgggtgagtgtacctttcgaataagcgccggctaactacgtgccagcagccgcggtaatacgtagggcgcaagcgttatccggaattattgggcgtaaagagcttgtaggcggttcgtcgcgtctggtgtgaaagcccatcgcttaacggtgggtttgcgccgggtacgggcgggctagagtgcagtaggggagactggaattctcggtgtaacggtggaatgtgtagatatcgggaagaacaccaatggcgaaggcaggtctctgggctgttactgacgctgagaagcgaaagcgtggggagcgaacaggattagataccctggtagtccacgccgtaaacggtggacgctggatgtggggcccattccacgggttctgtgtcggagctaacgcgttaagcgtcccgcctggggagtacggccgcaaggctaaaactcaaagaaattgacgggggcccgcacaagcggcggagcatgcggattaattcgatgcaacgcgaagaaccttacctgggcttgacatgtgcctgtcgactgcagagatgtggtttcccttcggggcaggttcacaggtggtgcatggtcgtcgtcagctcgtgtcgtgagatgttgggttaagtcccgcaacgagcgcaaccctcgccctgtgttgccagcgggttatgccgggaactcacgggggaccgccggggttaactcggaggaaggtggggatgacgtcagatcatcatgccccttacgtccagggcttcacgcatgctacaatggccggtacaacgggatgcgacatggtgacatggagcggatcccttaaaaccggtctcagttcggatcgtagtctgcaactcgactacgtgaaggcggagtcgctagtaatcgcgaatcagcaacgtcgcggtgaatgcgttcccgggccttgtacacaccgcccgtca

SEQ ID NO: 238 - DNA, 1445 bp, Artificial Sequence
  Granulicatella_sp_M658_99_3
  misc_feature (73)..(73): n is a, c, g, or t
  misc_feature (180)..(180): n is a, c, g, or t
acgctggcggcgtgcctaatacatgcaagtcgaacgcagtttcattcaccgagtgcttgcactcaccgaatgnactgagtggcgaacgggtgagtaacacgtgggtaacctgcccatcagtgggggataacagtcggaaacgactgctaataccgcatgattttcaacaccgcatggtgntgaaataaaagacggctttgctgtcgctgatggatggacccgcggcgtattagctagttggtgaggtaacggctcaccaaggcaatgatacgtagccggcctgagagggtaatcggccacattgggactgagacacggcccaaactcctacgggaggcagcagtagggaatcttccgcaatggacgaaagtctgacggagcaacgccgcgtgagtgaagaaggttttcggatcgtaaaactctgttgttagagaagaacaacctcttgagtaactgtaagaggtctgacggtatctaaccagaaagccacggctaactacgtgccagcagccgcggtaatacgtaggtggcaagcgttgtccggatttattgggcgtaaagcgagtgcaggcggttccttaagtctgatgtgaaagcccacggcttaaccgtggagggtcattggaaactggggaacttgagtgcagaagaggagagtggaattccatgtgtagcggtggaatgcgtagatatatggaggaacaccagtggcgaaggcgactctctggtctgtaactgacgctgaggctcgaaagcgtgggtagcaaacaggattagataccctggtagtccacgccgtaaacgatgagtgctaggtgttggagggtttccgcccttcagtgccgcagttaacgcattaagcactccgcctggggagtacggccgcaaggctgaaactcaaaggaattgacggggacccgcacaagcggtggagcatgtggtttaattcgaagcaacgcgaagaaccttaccaagtcttgacatcctttgaccactctagagatagagctttcccttcggggacaaagtgacaggtggtgcatggttgtcgtcagctcgtgtcgtgagatgttgggttaagtcccgcaacgagcgcaacccttatcattagttgccagcattcagttgggcactctagtgatactgccggtgacaaaccggaggaaggtggggatgacgtcaaatcagcatgccccttatgacttgggctacacacgtgctacaatggatggtacaacgagcagcaaacccgcgagggcaagcgaatctcttaaagccattctcagttcggattgttctctgcaactcgagaacatgaagccggaatcgctagtaatcgcggatcagcacgccgcggtgaatacgttcccgggtcttgtacacaccgcccgtcacaccacgagagtttgtaacacccaaagtcggtgaggtaacccttctgggag

SEQ ID NO: 239 - DNA, 1453 bp, Artificial Sequence
  Lachnobacterium_bovis
gtttgatcctggctcaggatgaacgctggcggcgtgcttaacacatgcaagtcgaacgaagcgcattgtttgaattcttcggaaggaagataatgtgactgagtggcggacgggtgagtaacgcgtgggtaacctgccatgtacagggggacaacagttggaaacggctgctaataccgcataagcgcacgagattgcatgatctagtgtgaaaaactccggtggtatatgatggacccgcgtctgattagctagttggtaaggtaacggcttaccaaggcgacgatcagtagccgacctgagagggtgaccggccacattgggactgagacacggcccagactcctacgggaggcagcagtggggaatattgcacaatgggcgaaagcctgatgcagcgacgccgcgtgaacgaagaagtatttcggtatgtaaagttctatcagcagggaagaagaaatgacggtacctgactaagaagccccggctaactacgtgccagcagccgcggtaatacgtagggggcaagcgttatccggatttactgggtgtaaagggagcgcaggcggcccggcaagtctgatgtgaaaacccaaggctcaaccatgggattgcattggaaactgtcgagctagagtatcggaggggtaagtggaattcctagtgtagcggtgaaatgcgtagatattaggaggaacaccagtggcgaaggcggcttactggacgataactgacgctgaggctcgaaagcgtggggagcaaacaggattagataccctggtagtccacgccgtaaacgatgaatactaggtgtcgggtgttattaacattcggtgccggcgcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccaatgacaatctatgtaatgtagactctcttcggagcaatggagacaggtggtgcatggttgtcgtcagctcgtgtcgtgagatgttgggttaagtcccgcaacgagcgcaacccttgtccttagtagccagcagtaagatgggcactctagggagactgccagggataacctggaggaaggtggggatgacgtcaaatcatcatgccccttatgacttgggctacacacgtgctacaatggcgtaaacaaagtgaagcgagatggtgacattaagcgaatcacaaaaataacgtctcagttcggactgtagtctgcaactcgactacacgaagctggaatcgctagtaatcgcagatcagaatgctgcggtgaatacgttcccgggtcttgtacacaccgcccgtcacaccatgggagttggtaatgcccgaagccggtgacctaaccgaaaggaaggagccgtcgaaggca

SEQ ID NO: 240 - DNA, 1493 bp, Artificial Sequence
  Lachnobacterium_bovis
  misc_feature (85)..(85): n is a, c, g, or t
gagtttgatcatggctcaggatgaacgctggcggcgtgcttaacacatgcaagtcgaacgaagcacattatttgaattcttcggnaggaagataatgcgactgagtggcggacgggtgagtaacgcgtgggtaacctgccatgtacagggggacaacagttggaaacggctgctaataccgcataagcgcacgagattgcatgatctagtgtgaaaaactccggtggtatatgatggacccgcgtctgattagctagttggtaaggtaacggcttaccaaggcgacgatcagtagccgacctgagagggtgaccggccacattgggactgagacacggcccagactcctacgggaggcagcagtggggaatattgcacaatgggcgaaagcctgatgcagcgacgccgcgtgaacgaagaagtatttcggtatgtaaagttctatcagcagggaagaaaaaatgacggtacctgactaagaagccccggctaactacgtgccagcagccgcggtaatacgtagggggcaagcgttatccggatttactgggtgtaaagggagcgcaggcggcccggcaagtctgatgtgaaaacccaaggctcaaccatgggattgcattggaaactgtcgagctagagtatcggaggggtaagtggaattcctagtgtagcggtgaaatgcgtagatattaggaggaacaccagtggcgaaggcggcttactggacgataactgacgctgaggctcgaaagcgtggggagcaaacaggattagataccctggtagtccacgccgtaaacgatgaatactaggtgtcgggtgttatgaacattcggtgccggcgcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccaatgacaagctatgtaatgtagcctctcttcggagcattggagacaggtggtgcatggttgtcgtcagctcgtgtcgtgagatgttgggttaagtcccgcaacgagcgcaacccttgtccttagtagccagcagtaagatgggcactctagggagactgccagggataacctggaggaaggtggggatgacgtcaaatcatcatgccccttatgacttgggctacacacgtgctacaatggcgtaaacaaagtgaagcgagatggtgacattaagcaaatcacaaaaataacgtctcagttcggactgtagtctgcaactcgactacacgaagctggaatcgctagtaatcgcagatcagaatgctgcggtgaatacgttcccgggtcttgtacacaccgcccgtcacaccatgggagttggtaatgcccgaagccggtgacctaaccgtaaggaaggagccgtcgaaggcaggatcgataactggggtgaagtcgtaacaaggtaacca

SEQ ID NO: 241 - DNA, 1519 bp, Artificial Sequence
  Lachnospiraceae_bacterium_1_1_57FAA
agagtttgatcctggctcaggatgaacgctggcggcgtgcctaacacatgcaagtcgagcgaagcactttgcttagattcttcggatgaagaggattgtgactgagcggcggacgggtgagtaacgcgtgggtaacctgcctcatacagggggataacagttagaaatgactgctaataccgcataagaccacagcaccgcatggtgcgggggtaaaaactccggtggtatgagatggacccgcgtctgattagctagttggtaaggtaacggcttaccaaggcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaaaatgacggtacctgactaagaagcaccggctaaatacgtgccagcagccgcggtaatacgtatggtgcaagcgttatccggatttactgggtgtaaagggagcgtagacggatgggcaagtctgatgtgaaaacccggggctcaaccccgggactgcattggaaactgttcatctagagtgctggagaggtaagtggaattcctagtgtagcggtgaaatgcgtagatattaggaggaacaccagtggcgaaggcggcttactggacagtaactgacgttgaggctcgaaagcgtggggagcaaacaggattagataccctggtagtccacgccgtaaacgatgactactaggtgtcgggtggcaaagccattcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctgctcttgacatcccgctgaccggacggtaatgcgtccttcccttcggggcagcggagacaggtggtgcatggttgtcgtcagctcgtgtcgtgagatgttgggttaagtcccgcaacgagcgcaacccctatctttagtagccagcggccaggccgggcactctagagagactgccggggataacccggaggaaggtggggatgacgtcaaatcatcatgccccttatgagcagggctacacacgtgctacaatggcgtaaacaaagggaagcgagaccgcgaggtggagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggagggagctgccgaaggcgggaccgataactggggtgaagtcgtaacaaggtagccgtatcggaaggtgcggctggatcacct

SEQ ID NO: 242 - DNA, 1527 bp, Artificial Sequence
  Lachnospiraceae_bacterium_1_4_56FAA
gagagtttgatcctggctcaggatgaacgctggcggcgtgcttaacacatgcaagtcgaacgaagcactttaccggatttcttcgggatgaaagttttgtgactgagtggcggacgggtgagtaacgcgtgggtaacctgcctcatacagggggataacagttagaaatgactgctaataccgcataagaccacaggattgcatgatccggtggtaaaaactccggtggtatgagatggacccgcgtctgattagctagttggtaaggtaacggcttaccaaggcgacgatcagtagccgacctgagagggtgaccggccacattgggactgagacacggcccaaactcctacgggaggcagcagtggggaatattgcacaatgggggaaaccctgatgcagcgacgccgcgtgagcgatgaagtatttcggtatgtaaagctctatcagcagggaagaaaatgacggtacctgactaagaagcaccggctaaatacgtgccagcagccgcggtaatacgtatggtgcaagcgttatccggatttactgggtgtaaagggagcgtagacggagaggcaagtctgatgtgaaaacccggggctcaaccccgggactgcattggaaactgtttttctagagtgtcggagaggtaagtggaattcctagtgtagcggtgaaatgcgtagatattaggaggaacaccagtggcgaaggcggcttactggacgatgactgacgttgaggctcgaaagcgtggggagcaaacaggattagataccctggtagtccacgccgtaaacgatgactgctaggtgtcgggaggcaaagcctttcggtgccgcagcaaacgcaataagcagtccacctggggagtacgttcgcaagaatgaaactcaaaggaattgacggggacccgcacaagcggtggagcatgtggtttaattcgaagcaacgcgaagaaccttacctgcccttgacatccggctgaccggcgagtaatgtcgcctttccttcgggacagccgagacaggtggtgcatggttgtcgtcagctcgtgtcgtgagatgttgggttaagtcccgcaacgagcgcaacccttatctttagtagccagcatttcggatgggcactctagagagactgccagggataacctggaggaaggtggggatgacgtcaaatcatcatgccccttatgggcagggctacacacgtgctacaatggcgtaaacaaagggaggcaagcctgcgagggtgagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagttggtaacgcccgaagtcagtgacccaaccgtaaggagggagctgccgaaggtgggaccgataactggggtgaagtcgtaacaaggtagccgtatcggaaggtgcggctggatcacctcctttct

SEQ ID NO: 243 - DNA, 1528 bp, Artificial Sequence
  Lachnospiraceae_bacterium_2_1_46FAA
gagagtttgatcctggctcaggatgaacgctggcggcgtgcttaacacatgcaagtcgaacgaagcgctttcgattgaatcttcggaggaaagaggaagtgactgagtggcggacgggtgagtaacgcgtgggtaacctgcctcatacagggggataacagttagaaatggctgctaataccgcataagcatacagcaccgcatggtgcagtgtgaaaaactccggtggtatgagatggacccgcgtctgattaggtagttggtggggtaacggcctaccaagccgacgatcagtagccgacctgagagggtgaccggccacattgggactgagacacggcccaaactcctacgggaggcagcagtggggaatattgcacaatgggggaaaccctgatgcagcgacgccgcgtgaaggaagaagtatttcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggaagtgcaagtctgaagtgaaagcccggggctcaaccccgtgactgctttggaaactgtgcttctagagtgtcggagaggtaagcggaattcctagtgtagcggtgaaatgcgtagatattaggaggaacatcagtggcgaaggcggcttactggacgataactgacgttgaggctcgaaagcgtggggagcaaacaggattagataccctggtagtccacgccgtaaacgatgactactaggtgtcggggtacaaagtacttcggtgccgcagccaacgcaataagtagtccacctggggagtacgttcgcaagaatgaaactcaaaggaattgacggggacccgcacaagcggtggagcatgtggtttaattcgaagcaacgcgaagaaccttacctggtcttgacatctccctgactggacagtaatgtgtcctttctttcgggacagggaagacaggtggtgcatggttgtcgtcagctcgtgtcgtgagatgttgggttaagtcccgcaacgagcgcaacccctatcttcagtagccagcaagtaaagttgggcactctggagagactgccagggataacctggaggaaggtggggacgacgtcaaatcatcatgccccttatgaccagggctacacacgtgctacaatggcgtaaacaaagggaagcaagcatgtgagtgtgagcaaatctcaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagttggtaacgcccgaagtcagtgacctaaccgaaaggaaggagctgccgaaggtgggactgataactggggtgaagtcgtaacaaggtagccgtatcggaaggtgcggctggatcacctcctttct

SEQ ID NO: 244 - DNA, 1528 bp, Artificial Sequence
  Lachnospiraceae_bacterium_2_1_58FAA
gagagtttgatcctggctcaggatgaacgctggcggcgtgcttaacacatgcaagtcgagcgaagcaccttgacggatttcttcggattgaagccttggtgactgagcggcggacgggtgagtaacgcgtgggtaacctgcctcatacagggggataacagttggaaacggctgctaataccgcataagcgcacagtaccgcatggtacggtgtgaaaaactccggtggtatgagatggacccgcgtctgattaggtagttggtggggtaacggcctaccaagccgacgatcagtagccgacctgagagggtgaccggccacattgggactgagacacggcccaaactcctacgggaggcagcagtggggaatattgcacaatgggggaaaccctgatgcagcgacgccgcgtgagcgatgaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcatggcaagccagatgtgaaagcccggggctcaaccccgggactgcatttggaactgtcaggctagagtgtcggagaggaaagcggaattcctagtgtagcggtgaaatgcgtagatattaggaggaacaccagtggcgaaggcggctttctggacgatgactgacgttgaggctcgaaagcgtggggagcaaacaggattagataccctggtagtccacgccgtaaacgatgaatactaggtgtcgggtggcaaagccattcggtgccgcagcaaacgcaataagtattccacctggggagtacgttcgcaagaatgaaactcaaaggaattgacggggacccgcacaagcggtggagcatgtggtttaattcgaagcaacgcgaagaaccttacctggtcttgacatccctctgaccgctctttaatcggagctttccttcgggacagaggagacaggtggtgcatggttgtcgtcagctcgtgtcgtgagatgttgggttaagtcccgcaacgagcgcaacccctatctttagtagccagcattttcggatgggcactctagagagactgccagggataacctggaggaaggtggggatgacgtcaaatcatcatgccccttatgaccagggctacacacgtgctacaatggcgtaaacaaagggaagcgagcccgcgagggggagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgcaaggagggagctgccgaaggtgggaccgataactggggtgaagtcgtaacaaggtagccgtatcggaaggtgcggctggatcacctcctttct

SEQ ID NO: 245 - DNA, 1493 bp, Artificial Sequence
  Lachnospiraceae_bacterium_3_1_57FAA
acaagagagtttgatcctggctcaggatgaacgctggcggcgtgcctaacacatgcaagtcgaacgaagttaacgaggaagttttcggatggaatcggtataacttagtggcggacgggtgagtaacgcgtgggaaacctgccctgtaccgggggataacacttagaaataggtgctaataccgcataagcgcacggaaccgcatggttcgtgtgaaaaactccggtggtacaggatggtcccgcgtctgattagccagttggcagggtaacggcctaccaaagcgacgatcagtagccggcctgagagggtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcatggcaagccagatgtgaaaacccagggctcaaccttgggattgcatttggaactgtcaggctggagtgcaggagaggtaagcggaattcctagtgtagcggtgaaatgcgtagatattaggaggaacaccagtggcgaaggcggcttactggactgtaactgacgttgaggctcgaaagcgtggggagcaaacaggattagataccctggtagtccacgcggtaaacgatgattgctaggtgtaggtgggtatggacccatcggtgccgcagctaacgcaataagcaatccacctggggagtacgttcgcaagaatgaaactcaaaggaattgacggggacccgcacaagcggtggagcatgtggtttaattcgaagcaacgcgaagaaccttaccaagtcttgacatcccaatgacgcacctgtaaagaggtgttcccttcggggcattggagacaggtggtgcatggttgtcgtcagctcgtgtcgtgagatgttgggttaagtcccgcaacgagcgcaacccttattcttagtagccagcaggtaaagctgggcactctaaggagactgccggggataacccggaggaaggcggggatgacgtcaaatcatcatgccccttatgatttgggctacacacgtgctacaatggcgtaaacaaagggaagcgagacagtgatgtggagcaaatcccagaaataacgtctcagttcggattgtagtctgcaactcgactacatgaagctggaatcgctagtaatcgcgaatcagcatgtcgcggtgaatacgttcccgggtcttgtacacaccgcccgtcacaccatgggagttggaaatgcccgaagtctgtgacctaaccgaaagggaggagcagccgaaggcaggtctgataactggggtgaagtcgtaacaaggtag

SEQ ID NO: 246 - DNA, 1527 bp, Artificial Sequence
  Lachnospiraceae_bacterium_4_1_37FAA
gagagtttgatcctggctcaggatgaacgctggcggcgtgcttaacacatgcaagtcgaacgaagcacttgaatggaattcttcggaaggaagctcaagtgactgagtggcggacgggtgagtaacgcgtgggtaacctgcctcatacagggggataacagttagaaatgactgctaataccgcataagcacacgtgatcgcatgatcgagtgtgaaaaactccggtggtatgagatggacccgcgtctgattagctagttggtggggtaacggcccaccaaggcgacgatcagtagccggcctgagagggtgaacggccacattgggactgagacacggcccaaactcctacgggaggcagcagtggggaatattgcacaatgggggaaaccctgatgcagcgacgccgcgtgaaggatgaagtatttcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggcagtgcaagtctgaagtgaaagcccggggctcaaccccgggactgctttggaaactgtgcagctagagtgtcggagaggcaagcggaattcctagtgtagcggtgaaatgcgtagatattaggaggaacaccagtggcgaaggcggcttgctggacgatgactgacgttgaggctcgaaagcgtggggagcaaacaggattagataccctggtagtccacgccgtaaacgatgactactaggtgtcggggagcaaagctcttcggtgccgcagccaacgcaataagtagtccacctggggagtacgttcgcaagaatgaaactcaaaggaattgacggggacccgcacaagcggtggagcatgtggtttaattcgaagcaacgcgaagaaccttacctgctcttgacatccctctgaccggcaagtaatgttgcctttccttcgggacagaggagacaggtggtgcatggttgtcgtcagctcgtgtcgtgagatgttgggttaagtcccgcaacgagcgcaacccctatcttcagtagccagcggtaaggccgggcactctggagagactgccagggataacctggaggaaggtggggatgacgtcaaatcatcatgccccttatgagcagggctacacacgtgctacaatggcgtaaacaaagggaagcagagtcgtgaggccgagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgcaaggagggagctgccgaaggtgggaccgataactggggtgaagtcgtaacaaggtagccgtatcggaaggtgcggctggatcacctcctttct

SEQ ID NO: 247 - DNA, 1531 bp, Artificial Sequence
  Lachnospiraceae_bacterium_5_1_57FAA
gagagtttgatcctggctcaggatgaacgctggcggcgtgcctaacacatgcaagtcgaacgaagcgcctggccccgacttcttcggaacgaggagccttgcgactgagtggcggacgggtgagtaacgcgtgggcaacctgccttgcactgggggataacagccagaaatggctgctaataccgcataagaccgaagcgccgcatggcgcggcggccaaagccccggcggtgcaagatgggcccgcgtctgattaggtagttggcggggtaacggcccaccaagccgacgatcagtagccgacctgagagggtgaccggccacattgggactgagacacggcccagactcctacgggaggcagcagtggggaatattgcacaatgggggaaaccctgatgcagcgacgccgcgtgaaggatgaagtatttcggtatgtaaacttctatcagcagggaagaagatgacggtacctgactaagaagccccggctaactacgtgccagcagccgcggtaatacgtagggggcaagcgttatccggatttactgggtgtaaagggagcgtagacggcgatgcaagccagatgtgaaagcccggggctcaaccccgggactgcatttggaactgcgtggctggagtgtcggagaggcaggcggaattcctagtgtagcggtgaaatgcgtagatattaggaggaacaccagtggcgaaggcggcctgctggacgatgactgacgttgaggctcgaaagcgtggggagcaaacaggattagataccctggtagtccacgccgtaaacgatgactactaggtgtcgggtggcaaggccattcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctgatcttgacatcccgatgccaaagcgcgtaacgcgctctttcttcggaacatcggtgacaggtggtgcatggttgtcgtcagctcgtgtcgtgagatgttgggttaagtcccgcaacgagcgcaacccctatcttcagtagccagcattatggatgggcactctggagagactgccagggagaacctggaggaaggtggggatgacgtcaaatcatcatgccccttatgaccagggctacacacgtgctacaatggcgtaaacaaagggaggcgaacccgcgagggtgggcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagccggtgacccaacccgtaagggagggagccgtcgaaggtgggaccgataactggggtgaagtcgtaacaaggtagccgtatcggaaggtgcggctggatcacctcctttct

SEQ ID NO: 248 - DNA, 1527 bp, Artificial Sequence
  Lachnospiraceae_bacterium_6_1_63FAA
gagagtttgatcctggctcaggatgaacgctggcggcgtgcttaacacatgcaagtcgagcgaagcacttatcattgactcttcggaagatttgatatttgactgagcggcggacgggtgagtaacgcgtgggtaacctgcctcatacaggggaataacagttagaaatggctgctaatgccgcataagcgcacaggaccgcatggtctggtgtgaaaaactgaggtggtatgagatggacccgcgtctgattaggtagttggtggggtaacggcctaccaagccgacgatcagtagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggaagagcaagtctgatgtgaaaggctggggcttaaccccaggactgcattggaaactgtttttctagagtgccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcggggtgcaaagcagttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatctgcctgaccgttccttaaccggagctttccttcgggacaggcaagacaggtggtgcatggttgtcgtcagctcgtgtcgtgagatgttgggttaagtcccgcaacgagcgcaacccctatccttagtagccagcagtccggctgggcactctagggagactgccggggataacccggaggaaggcggggacgacgtcaaatcatcatgccccttatgatttgggctacacacgtgctacaatggcgtaaacaaagggaagcgaagcggtgacgcttagcaaatctcaaaaataacgtcccagttcggactgcagtctgcaactcgactgcacgaagctggaatcgctagtaatcgcgaatcagaatgtcgcggtgaatacgttcccgggtcttgtacacaccgcccgtcacaccatgggagtcagtaacgcccgaagtcagtgacccaaccttatggagggagctgccgaaggcgggaccgataactggggtgaagtcgtaacaaggtagccgtatcggaaggtgcggctggatcacctcctttct

SEQ ID NO: 249 - DNA, 1527 bp, Artificial Sequence
  Lachnospiraceae_bacterium_8_1_57FAA
gagagtttgatcctggctcaggatgaacgctggcggcgtgcctaacacatgcaagtcgagcgaagcactttgcttagattcttcggatgaagaggattgtgactgagcggcggacgggtgagtaacgcgtgggtaacctgcctcatacagggggataacagttagaaatgactgctaataccgcataagaccacagcaccgcatggtgcgggggtaaaaactccggtggtatgagatggacccgcgtctgattagctagttggtaaggtaacggcttaccaaggcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaaaatgacggtacctgactaagaagcaccggctaaatacgtgccagcagccgcggtaatacgtatggtgcaagcgttatccggatttactgggtgtaaagggagcgtagacggatgggcaagtctgatgtgaaaacccggggctcaaccccgggactgcattggaaactgttcatctagagtgctggagaggtaagtggaattcctagtgtagcggtgaaatgcgtagatattaggaggaacaccagtggcgaaggcggcttactggacagtaactgacgttgaggctcgaaagcgtggggagcaaacaggattagataccctggtagtccacgccgtaaacgatgactactaggtgtcgggtggcaaagccattcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctgctcttgacatcccgctgaccggacggtaatgcgtccttcccttcggggcagcggagacaggtggtgcatggttgtcgtcagctcgtgtcgtgagatgttgggttaagtcccgcaacgagcgcaacccctatctttagtagccagcggccaggccgggcactctagagagactgccggggataacccggaggaaggtggggatgacgtcaaatcatcatgccccttatgagcagggctacacacgtgctacaatggcgtaaacaaagggaagcgagaccgcgaggtggagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggagggagctgccgaaggcgggaccgataactggggtgaagtcgtaacaaggtagccgtatcggaaggtgcggctggatcacctcctttct

SEQ ID NO: 250 - DNA, 1527 bp, Artificial Sequence
  Lachnospiraceae_bacterium_9_1_43BFAA
gagagtttgatcctggctcaggatgaacgctggcggcgtgcttaacacatgcaagtcgaacgaagcacttgaatggaattcttcggaaggaagctcaagtgactgagtggcggacgggtgagtaacgcgtgggtaacctgcctcatacagggggataacagttagaaatgactgctaataccgcataagcacacgtgatcgcatgatcgagtgtgaaaaactccggtggtatgagatggacccgcgtctgattagctagttggtggggtaatggcccaccaaggcgacgatcagtagccggcctgagagggtgaacggccacattgggactgagacacggcccaaactcctacgggaggcagcagtggggaatattgcacaatgggggaaaccctgatgcagcgacgccgcgtgaaggatgaagtatttcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggcagtgcaagtctgaagtgaaagcccggggctcaaccccgggactgctttggaaactgtgcagctagagtgtcggagaggcaagcggaattcctagtgtagcggtgaaatgcgtagatattaggaggaacaccagtggcgaaggcggcttgctggacgatgactgacgttgaggctcgaaagcgtggggagcaaacaggattagataccctggtagtccacgccgtaaacgatgactactaggtgtcggggagcaaagctcttcggtgccgcagccaacgcaataagtagtccacctggggagtacgttcgcaagaatgaaactcaaaggaattgacggggacccgcacaagcggtggagcatgtggtttaattcgaagcaacgcgaagaaccttacctgctcttgacatccctctgaccgctctttaatcggagctttccttcgggacagaggagacaggtggtgcatggttgtcgtcagctcgtgtcgtgagatgttgggttaagtcccgcaacgagcgcaacccctatcttcagtagccagcggtaaggccgggcactctggagagactgccagggataacctggaggaaggtggggatgacgtcaaatcatcatgccccttatgagcagggctacacacgtgctacaatggcgtaaacaaagggaagcagagtcgtgaggccgagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgcaaggagggagctgccgaaggtgggaccgataactggggtgaagtcgtaacaaggtagccgtatcggaaggtgcggctggatcacctcctttct

SEQ ID NO: 251 - DNA, 1487 bp, Artificial Sequence
  Lachnospiraceae_bacterium_oral_taxon_F15
agagtttgatcctggctcaggatgaacgctggcggcgtgcttaacacatgcaagtcgaacgaagcatttagaagttttcggacggaagaatgacttagtggcggacgggtgagtaacgcgtgggtaacctgccttatacagggggataacagttggaaacgactgctaataccgcataacccgatagagtcgcatgacttagtcggaaaagatttatcggtataagatggacccgcgtctgattagctagttggtgaggtaatggcccaccaaggcgacgatcagtagccggcttgagagagtgaacggccacattgggactgagacacggcccaaactcctacgggaggcagcagtggggaatattgcacaatgggggaaaccctgatgcagcaacgccgcgtgaaggatgaagtatttcggtatgtaaacttctatcagcagggaagaaattgacggtacctgactaagaagccccggctaactacgtgccagcagccgcggtaatacgtagggggcaagcgttatccggatttactgggtgtaaagggagcgtaggcggcaatgcaagtccgatgtgaaagcccggggctcaaccccgggactgcattagaaactgtgttgctagagtgcaggagaggtaagtggaattcctagtgtagcggtgaaatgcgtagatattaggaggaacaccagtggcgaaggcgacttactggactgaaactgacgctgaggctcgaaagcgtggggagcaaacaggattagataccctggtagtccacgccgtaaacgatgaatactaggtgtcggggcccatccgggcttcggtgccgcggctaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccattgaccgtcccgtaacggggacttctcttcggagcaatggagacaggtggtgcatggttgtcgtcagctcgtgtcgtgagatgttgggttaagtcccgcaacgagcgcagcccttatctttagtagccagcatttaaggtgggcactctagagagactgccggggataacccggaggaaggcggggatgacgtcaaatcatcatgccccttatgatttgggctacacacgtgctacaatggcgtaaacaaagggaagcaacagggtgacctcaagcaaatcccaaaaataacgtcccagttcggattgtagtctgcaactcgactacatgaagctggaatcgctagtaatcgcggatcagaatgccgcggtgaatacgttcccgggtcttgtacacaccgcccgtcacaccatgggagtcggaaatgcccgaagtcagtgacccaaccgcaaggagggagctgccgaaggtggagccgataactggggtgaagtcgtaacaaggtagccgt

SEQ ID NO: 252 - DNA, 1561 bp, Artificial Sequence
  Lactobacillus_acidophilus
gagagtttgatcctggctcaggacgaacgctggcggcgtgcctaatacatgcaagtcgagcgagctgaaccaacagattcacttcggtgatgacgttgggaacgcgagcggcggatgggtgagtaacacgtggggaacctgccccatagtctgggataccacttggaaacaggtgctaataccggataagaaagcagatcgcatgatcagcttataaaaggcggcgtaagctgtcgctatgggatggccccgcggtgcattagctagttggtagggtaacggcctaccaaggcaatgatgcatagccgagttgagagactgatcggccacattgggactgagacacggcccaaactcctacgggaggcagcagtagggaatcttccacaatggacgaaagtctgatggagcaacgccgcgtgagtgaagaaggttttcggatcgtaaagctctgttgttggtgaagaaggatagaggtagtaactggcctttatttgacggtaatcaaccagaaagtcacggctaactacgtgccagcagccgcggtaatacgtaggtggcaagcgttgtccggatttattgggcgtaaagcgagcgcaggcggaagaataagtctgatgtgaaagccctcggcttaaccgaggaactgcatcggaaactgtttttcttgagtgcagaagaggagagtggaactccatgtgtagcggtggaatgcgtagatatatggaagaacaccagtggcgaaggcggctctctggtctgcaactgacgctgaggctcgaaagcatgggtagcgaacaggattagataccctggtagtccatgccgtaaacgatgagtgctaagtgttgggaggtttccgcctctcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatctagtgcaatccgtagagatacggagttcccttcggggacactaagacaggtggtgcatggctgtcgtcagctcgtgtcgtgagatgttgggttaagtcccgcaacgagcgcaacccttgtcattagttgccagcattaagttgggcactctaatgagactgccggtgacaaaccggaggaaggtggggatgacgtcaagtcatcatgccccttatgacctgggctacacacgtgctacaatggacagtacaacgaggagcaagcctgcgaaggcaagcgaatctcttaaagctgttctcagttcggactgcagtctgcaactcgactgcacgaagctggaatcgctagtaatcgcggatcagcacgccgcggtgaatacgttcccgggccttgtacacaccgcccgtcacaccatgggagtctgcaatgcccaaagccggtggcctaaccttcgggaaggagccgtctaaggcagggcagatgactggggtgaagtcgtaacaaggtagccgtaggagaacctgcggctggatcacctcctttcta

SEQ ID NO: 253 - DNA, 1572 bp, Artificial Sequence
  Lactobacillus_acidophilus
aaaacgagagtttgatcctggctcaggacgaacgctggcggcgtgcctaatacatgcaagtcgagcgagctgaaccaacagattcacttcggtgatgacgttgggaacgcgagcggcggatgggtgagtaacacgtggggaacctgccccatagtctgggataccacttggaaacaggtgctaataccggataagaaagcagatcgcatgatcagcttataaaaggcggcgtaagctgtcgctatgggatggccccgcggtgcattagctagttggtagggtaacggcctaccaaggcaatgatgcatagccgagttgagagactgatcggccacattgggactgagacacggcccaaactcctacgggaggcagcagtagggaatcttccacaatggacgaaagtctgatggagcaacgccgcgtgagtgaagaaggttttcggatcgtaaagctctgttgttggtgaagaaggatagaggtagtaactggcctttatttgacggtaatcaaccagaaagtcacggctaactacgtgccagcagccgcggtaatacgtaggtggcaagcgttgtccggatttattgggcgtaaagcgagcgcaggcggaagaataagtctgatgtgaaagccctcggcttaaccgaggaactgcatcggaaactgtttttcttgagtgcagaagaggagagtggaactccatgtgtagcggtggaatgcgtagatatatggaagaacaccagtggcgaaggcggctctctggactgcaactgacgctgaggctagaaagcatgggtagcgaacaggattagataccttggtagtccatgccgaaaacgatgagtgctaagtgttgggaggtttccgcctttcagagctgcagctaacgcattaagcactccgcctggggagtacgaccgcatggttgatactcaaaggaattgacgggggcccgcacaagcgggggagcatgtggtttaattcgaagcaacgcgaagaaccttaccaggtcttgacatctagtgcaatccgtagagatacggagttcccttcggggacactaagacaggtggtgcatggctgtcgtcagctcgtgtcgtgagatgttgggttaagtcccgcaacgagcgcaacctttgtcattagttgccagcattaagttgggcactctaatgagactgccggtgacaaaccggaggaaggtggggatgacgtcaagtcatcatgccccttatgacctgggctacacacgtgctacattggacagtacaacgaggagcaagcctgcgaaggcaagcgaatctcttaaagctgatctcagttcggactgcagtctgcaactcgactgcacgaagctggaatcgctagtaatcgcggatcagcacgccgcggtgaatacgttcccgggccttgtacacaccgcccgtcacaccatgggagtctgcaatgcccaaagccggtggcctaaccttcgggatggagccgtctaaggcagggcagatgactggggtgaagtcgtaacaaggtagccgtaggagaacctgcggctggatcacctcctttctaaggaag

SEQ ID NO: 254 - DNA, 1276 bp, Artificial Sequence
  Lactobacillus_fermentum
aacgagtggcggacgggtgagtaacacgtaggtaacctgcccagaagcgggggacaacatttggaaacagatgctaataccgcataacaacgttgttcgcatgaacaacgcttaaaagatggcttctcgctatcacttctggatggacctgcggtgcattagcttgttggtggggtaacggcctaccaaggcgatgatgcatagccgagttgagagactgatcggccacaatgggactgagacacggcccatactcctacgggaggcagcagtagggaatcttccacaatgggcgcaagcctgatggagcaacaccgcgtgagtgaagaagggtttcggctcgtaaagctctgttgttaaagaagaacacgtatgagagtaactgttcatacgttgacggtatttaaccagaaagtcacggctaactacgtgccagcagccgcggtaatacgtaggtggcaagcgttatccggatttattgggcgtaaagagagtgcaggcggttttctaagtctgatgtgaaagccttcggcttaaccggagaagtgcatcggaaactggataacttgagtgcagaagagggtagtggaactccatgtgtagcggtggaatgcgtagatatatggaagaacaccagtggcgaaggcggctacctggtctgcaactgacgctgagactcgaaagcatgggtagcgaacaggattagataccctggtagtccatgccgtaaacgatgagtgctaggtgttggagggtttccgcccttcagtgccggagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttgcgccaaccctagagatagggcgtttccttcgggaacgcaatgacaggtggtgcatggtcgtcgtcagctcgtgtcgtgagatgttgggttaagtcccgcaacgagcgcaacccttgttactagttgccagcattaagttgggcactctagtgagactgccggtgacaaaccggaggaaggtggggacgacgtcagatcatcatgccccttatgacctgggctacacacgtgctacaatggacggtacaacgagtcgcgaactcgcgagggcaagcaaatctcttaaaaccgttctcagttcggactgcaggctgcaactcgcctgcacgaagtcggaatcgctagtaatcgcggatcag

SEQ ID NO: 255 - DNA, 1373 bp, Artificial Sequence
  Lactobacillus_fermentum
ttttatatgagagtttgatcctggctcaggatgaacgccggcggtgtgcctaatacatgcaagtcgaacgcgttggcccaattgattgatggtgcttgcacctgattgattttggtcgccaacgagtggcggacgggtgagtaacacgtaggtaacctgcccagaagcgggggacaacatttggaaacagatgctaataccgcataacaacgttgttcgcatgaacaacgcttaaaagatggcttctcgctatcacttctggatggacctgcggtgcattagcttgttggtggggtaacggcctaccaaggcgatgatgcatagccgagttgagagactgatcggccacaatgggactgagacacggcccatactcctacgggaggcagcagtagggaatcttccacaatgggcgcaagcctgatggagcaacaccgcgtgagtgaagaagggtttcggctcgtaaagctctgttgttaaagaagaacacgtatgagagtaactgttcatacgttgacggtatttaaccagaaagtcacggctaactacgtgccagcagccgcggtaatacgtaggtggcaagcgttatccggatttattgggcgtaaagagagtgcaggcggttttctaagtctgatgtgaaagccttcggcttaaccggagaagtgcatcggaaactggataacttgagtgcagaagagggtagtggaactccatgtgtagcggtggaatgcgtagatatatggaagaacaccagtggcgaaggcggctacctggtctgcaactgacgctgagactcgaaagcatgggtagcgaacaggattagataccctggtagtccatgccgtaaacgatgagtgctaggtgttggagggtttccgcccttcagtgccggagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttgcgccaaccctagagatagggcgtttccttcgggaacgcaatgacaggtggtgcatggtcgtcgtcagctcgtgtcgtgagatgttgggttaagtcccgcaacgagcgcaacccttgttactagttgccagcattaagttgggcactctagtgagactgccggtgacaaaccggaggaaggtggggacgacgtcagatcatcatgccccttatgacctgggctacacacgtgctacaatggacggtacaacgagtcgcgaactcgcgagggcaagcaaatctcttaaaaccgttctcagttcggactgcaggctgcaactcgcctgcacgaagtcgg

SEQ ID NO: 256 - DNA, 1580 bp, Artificial Sequence
  Lactobacillus_fermentum
ttttatatgagagtttgatcctggctcaggatgaacgccggcggtgtgcctaatacatgcaagtcgaacgcgttggcccaattgattgatggtgcttgcacctgattgattttggtcgccaacgagtggcggacgggtgagtaacacgtaggtaacctgcccagaagcgggggacaacatttggaaacagatgctaataccgcataacagcgttgttcgcatgaacaacgcttaaaagatggcttctcgctatcacttctggatggacctgcggtgcattagcttgttggtggggtaacggcctaccaaggcgatgatgcatagccgagttgagagactgatcggccacaatgggactgagacacggcccatactcctacgggaggcagcagtagggaatcttccacaatgggcgcaagcctgatggagcaacaccgcgtgagtgaagaagggtttcggctcgtaaagctctgttgttaaagaagaacacgtatgagagtaactgttcatacgttgacggtatttaaccagaaagtcacggctaactacgtgccagcagccgcggtaatacgtaggtggcaagcgttatccggatttattgggcgtaaagagagtgcaggcggttttctaagtctgatgtgaaagccttcggcttaaccggagaagtgcatcggaaactggataacttgagtgcagaagagggtagtggaactccatgtgtagcggtggaatgcgtagatatatggaagaacaccagtggcgaaggcggctacctggtctgcaactgacgctgagactcgaaagcatgggtagcgaacaggattagataccctggtagtccatgccgtaaacgatgagtgctaggtgttggagggtttccgcccttcagtgccggagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttgcgccaaccctagagatagggcgtttccttcgggaacgcaatgacaggtggtgcatggtcgtcgtcagctcgtgtcgtgagatgttgggttaagtcccgcaacgagcgcaacccttgttactagttgccagcattaagttgggcactctagtgagactgccggtgacaaaccggaggaaggtggggacgacgtcagatcatcatgccccttatgacctgggctacacacgtgctacaatggacggtacaacgagtcgcgaactcgcgagggcaagcaaatctcttaaaaccgttctcagttcggactgcaggctgcaactcgcctgcacgaagtcggaatcgctagtaatcgcggatcagcatgccgcggtgaatacgttcccgggccttgtacacaccgcccgtcacaccatgagagtttgtaacacccaaagtcggtggggtaaccttttaggagccagccgcctaaggtgggacagatgattagggtgaagtcgtaacaaggtagccgtaggagaacctgcggctggatcacctcctttct

SEQ ID NO: 257 - DNA, 1580 bp, Artificial Sequence
  Lactobacillus_fermentum
ttttatatgagagtttgatcctggctcaggatgaacgccggcggtgtgcctaatacatgcaagtcgaacgcgttggcccaattgattgatggtgcttgcacctgattgattttggtcgccaacgagtggcggacgggtgagtaacacgtaggtaacctgcccagaagcgggggacaacatttggaaacagatgctaataccgcataacaacgttgttcgcatgagcaacgcttaaaagatggcttctcgctatcacttctggatggacctgcggtgcattagcttgttggtggggtaacggcctaccaaggcgatgatgcatagccgagttgagagactgatcggccacaatgggactgagacacggcccatactcctacgggaggcagcagtagggaatcttccacaatgggcgcaagcctgatggagcaacaccgcgtgagtgaagaagggtttcggctcgtaaagctctgttgttaaagaagaacacgtatgagagtaactgttcatacgttgacggtatttaaccagaaagtcacggctaactacgtgccagcagccgcggtaatacgtaggtggcaagcgttatccggatttattgggcgtaaagagagtgcaggcggttttctaagtctgatgtgaaagccttcggcttaaccggagaagtgcatcggaaactggataacttgagtgcagaagagggtagtggaactccatgtgtagcggtggaatgcgtagatatatggaagaacaccagtggcgaaggcggctacctggtctgcaactgacgctgagactcgaaagcatgggtagcgaacaggattagataccctggtagtccatgccgtaaacgatgagtgctaggtgttggagggtttccgcccttcagtgccggagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttgcgccaaccctagagatagggcgtttccttcgggaacgcaatgacaggtggtgcatggtcgtcgtcagctcgtgtcgtgagatgttgggttaagtcccgcaacgagcgcaacccttgttactagttgccagcattaagttgggcactctagtgagactgccggtgacaaaccggaggaaggtggggacgacgtcagatcatcatgccccttatgacctgggctacacacgtgctacaatggacggtacaacgagtcgcaaactcgcgagggcaagcaaatctcttaaaaccgttctcagttcggactgcaggctgcaactcgcctgcacgaagtcggaatcgctagtaatcgcggatcagcatgccgcggtgaatacgttcccgggccttgtacacaccgcccgtcacaccatgagagtttgtaacacccaaagtcggtggggtaaccttttaggagccagccgcctaaggtgggacagatgattagggtgaagtcgtaacaaggtagccgtaggagaacctgcggctggatcacctcctttct

SEQ ID NO: 258 - DNA, 1201 bp, Artificial Sequence
  Lactobacillus_fermentum
  misc_feature (12)..(12): n is a, c, g, or t
  misc_feature (197)..(197): n is a, c, g, or t
tgagtttgatcntggctcaggatgaacgccggcggtgtgcctaatacatgcaagtcgaacgagtggcggacgggtgagtaacacgtaggtaacctgcccagaagcgggggacaacatttggaaacagatgctaataccgcataacaaaagtcacttctggatggacctgcggtgcattagcttgttggtggggtaanggcctaccaaggcgatgatgcatagccgagttgagagactgatcggccacaatgggactgagacacggcccatactcctacgggaggcagcagtagggaatcttccacaatgggcgcaagcctgatggagcaacaccgcgtgagtgaagaagggtttcggctcgtaaagctctgttgttaaagaagatgacggtatttaaccagaaagtcacggctaactacgtgccagcagccgcggtaatacgtaggtggcaagcgttatccggatttattgggcgtaaagagagtgcaggcggttttctaagtctgatgtgaaagccttcggcttaaccggagaagtgcatcggaaactggataacttgagtgcagaagagggtagtggaactccatgtgtagcggtggaatgcgtagatatatggaagaacaccagtggcgaaggcggctacctggtctgactgacgctgagactcgaaagcatgggtagcgaacaggattagataccctggtagtccatgccgtaaacgatgagtgctaggtgttggagcttcagtgccggagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcgacaggtggtgcatggtcgtcgtcagctcgtgtcgtgagatgttgggttaagtcccgcaacgagcgcaacccttgttactagttgccagcatgggcactctagtgagactgccggtgacaaaccggaggaaggtggggacgacgtcagatcatcatgccccttatgacctgggctacacacgtgctacaatggacggcaacgagtcgcgaactcgcgagggcaagcaaatctcttccgttctcagttcggatgcaggctgcaactcgcctgcagaagtcggaatcgctagtaatcgcggatcagcatgc

SEQ ID NO: 259 - DNA, 1225 bp, Artificial Sequence
  Lactobacillus_fermentum
agtggcggacgggtgagtaacacgtaggtaacctgcccagaagcgggggacaacatttggaaacagatgctaataccgcataacaaaagtcacttctggatggacctgcggtgcattagcttgttggtggggtaacggcctaccaaggcgatgatgcatagccgagttgagagactgatcggccacaatgggactgagacacggcccatactcctacgggaggcagcagtagggaatcttccacaatgggcgcaagcctgatggagcaacaccgcgtgagtgaagaagggtttcggctcgtaaagctctgttgttaaagaagatgacggtatttaaccagaaagtcacggctaactacgtgccagcagccgcggtaatacgtaggtggcaagcgttatccggatttattgggcgtaaagagagtgcaggcggttttctaagtctgatgtgaaagccttcggcttaaccggagaagtgcatcggaaactggataacttgagtgcagaagagggtagtggaactccatgtgtagcggtggaatgcgtagatatatggaagaacaccagtggcgaaggcggctacctggtctgactgacgctgagactcgaaagcatgggtagcgaacaggattagataccctggtagtccatgccgtaaacgatgagtgctaggtgttggagcttcagtgccggagctaacgcattaagcactccgcctggggagtacgaccgcaaggttgaaactcaaaggatttgacgggggcccgcacaagcggtggagcatgtggtttaattcgaagctacgcgaagaaccttaccaggtcttgacatcgacaggtggtgcatggtcgtcgtcagctcgtgtcgtgagatgttgggttaagtcccgcaacgagcgcaacccttgttactagttgccagcatgggcactctagtgagactgccggtgacaaaccggaggaaggtggggacgacgtcagatcatcatgccccttatgacctgggctacacacgtgctacaatggacggcaacgagtcgcgaactcgcgagggcaagcaaatctcttccgttctcagttcggatgcaggctgcaactcgcctgcagaagtcggaatcgctagtaatcgcggatcagcatgccgcggtgaatacgttcccgggccttgtacacaccgcccgtcacaccatgagagtttgtaacacccaaagtcggtgggtagccagc

SEQ ID NO: 260 - DNA, 1571 bp, Artificial Sequence
  Lactobacillus_gasseri
tgagagtttgatcctggctcaggacgaacgctggcggcgtgcctaatacatgcaagtcgagcgagcttgcctagatgaatttggtgcttgcaccagatgaaactagatacaagcgagcggcggacgggtgagtaacacgtgggtaacctgcccaagagactgggataacacctggaaacagatgctaataccggataacaacactagacgcatgtctagagtttaaaagatggttctgctatcactcttggatggacctgcggtgcattagctagttggtaaggcaacggcttaccaaggcaatgatgcatagccgagttgagagactgatcggccacattgggactgagacacggcccaaactcctacgggaggcagcagtagggaatcttccacaatggacgcaagtctgatggagcaacgccgcgtgagtgaagaagggtttcggctcgtaaagctctgttggtagtgaagaaagatagaggtagtaactggcctttatttgacggtaattacttagaaagtcacggctaactacgtgccagcagccgcggtaatacgtaggtggcaagcgttgtccggatttattgggcgtaaagcgagtgcaggcggttcaataagtctgatgtgaaagccttcggctcaaccggagaattgcatcagaaactgttgaacttgagtgcagaagaggagagtggaactccatgtgtagcggtggaatgcgtagatatatggaagaacaccagtggcgaaggcggctctctggtctgcaactgacgctgaggctcgaaagcatgggtagcgaacaggattagataccctggtagtccatgccgtaaacgatgagtgctaagtgttgggaggtttccgcctctcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccagtgcaaacctaagagattaggagttcccttcggggacgctgagacaggtggtgcatggctgtcgtcagctcgtgtcgtgagatgttgggttaagtcccgcaacgagcgcaacccttgtcattagttgccatcattaagttgggcactctaatgagactgccggtgacaaaccggaggaaggtggggatgacgtcaagtcatcatgccccttatgacctgggctacacacgtgctacaatggacggtacaacgagaagcgaacctgcgaaggcaagcggatctctgaaagccgttctcagttcggactgtaggctgcaactcgcctacacgaagctggaatcgctagtaatcgcggatcagcacgccgcggtgaatacgttcccgggccttgtacacaccgcccgtcacaccatgagagtctgtaacacccaaagccggtgggataacctttataggagtcagccgtctaaggtaggacagatgattagggtgaagtcgtaacaaggtagccgtaggagaacctgcggctggatcacctcctttcta

SEQ ID NO: 261 - DNA, 1533 bp, Artificial Sequence
  Lactobacillus_gasseri
gagtttgatcctggctcaggacgaacgctggcggcgtgcctaatacatgcaagtcgagcgagcttgcctagatgaatttggtgcttgcaccaaatgaaactagatacaagcgagcggcggacgggtgagtaacacgtgggtaacctgcccaagagactgggataacacctggaaacagatgctaataccggataacaacactagacgcatgtctagagtttaaaagatggttctgctatcactcttggatggacctgcggtgcattagctagttggtaaggtaacggcttaccaaggcaatgatgcatagccgagttgagagactgatcggccacattgggactgagacacggcccaaactcctacgggaggcagcagtagggaatcttccacaatggacgcaagtctgatggagcaacgccgcgtgagtgaagaagggtttcggctcgtaaagctctgttggtagtgaagaaagatagaggtagtaactggcctttatttgacggtaattacttagaaagtcacggctaactacgtgccagcagccgcggtaatacgtaggtggcaagcgttgtccggatttattgggcgtaaagcgagtgcaggcggttcaataagtctgatgtgaaagccttcggctcaaccggagaattgcatcagaaactgttgaacttgagtgcagaagaggagagtggaactccatgtgtagcggtggaatgcgtagatatatggaagaacaccagtggcgaaggcggctctctggtctgcaactgacgctgaggctcgaaagcatgggtagcgaacaggattagataccctggtagtccatgccgtaaacgatgagtgctaagtgttgggaggtttccgcctctcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccagtgcaaacctaagagattaggagttcccttcggggacgctgagacaggtggtgcatggctgtcgtcagctcgtgtcgtgagatgttgggttaagtcccgcaacgagcgcaacccttgtcattagttgccatcattaagttgggcactctaatgagactgccggtgacaaaccggaggaaggtggggatgacgtcaagtcatcatgccccttatgacctgggctacacacgtgctacaatggacggtacaacgagaagcgaacctgcgaaggcaagcggatctctgaaagccgttctcagttcggactgtaggctgcaactcgcctacacgaagctggaatcgctagtaatcgcggatcagcacgccgcggtgaatacgttcccgggccttgtacacaccgcccgtcacaccatgagagtctgtaacacccaaagccggtgggataacctttataggagtcagccgtctaaggtaggacagatgattagggtgaagtcgtaacaaggtagcc

SEQ ID NO: 262 - DNA, 1570 bp, Artificial Sequence
  Lactobacillus_gasseri
tgagagtttgatcctggctcaggacgaacgctggcggcgtgcctaatacatgcaagtcgagcgagcttgcctagatgaatttggtgcttgcaccaaatgaaactagatacaagcgagcggcggacgggtgagtaacacgtgggtaacctgcccaagagactgggataacacctggaaacagatgctaataccggataacaacactagacgcatgtctagagtttaaaagatggttctgctatcactcttggatggacctgcggtgcattagctagttggtaaggtaacggcttaccaaggcaatgatgcatagccgagttgagagactgatcggccacattgggactgagacacggcccaaactcctacgggaggcagcagtagggaatcttccacaatggacgcaagtctgatggagcaacgccgcgtgagtgaagaagggtttcggctcgtaaagctctgttggtagtgaagaaagatagaggtagtaactggcctttatttgacggtaattacttagaaagtcacggctaactacgtgccagcagccgcggtaatacgtaggtggcaagcgctgtccggatttattgggcgtaaagcgagtgcaggcggttcaataagtctgatgtgaaagcctttggctcaaccggagaattgcatcagaaactgttgaacttgagtgcagaagaggagagtggaactccatgtgtagcggtggaatgcgtagatatatggaagaacaccagtggcgaaggcggctctctggtctgcaactgacgctgaggctcgaaagcatgggtagcgaacaggattagataccctggtagtccatgccgtaaacgatgagtgctaagtgttgggaggtttccgcctctcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccagtgcaaacctaagagattaggtgttcccttcggggacgctgagacaggtggtgcatggctgtcgtcagctcgtgtcgtgagatgttgggttaagtcccgcaacgagcgcaacccttgtcattagttgccatcattaagttgggcactctaatgagactgccggtgacaaaccggaggaaggtggggatgacgtcaagtcatcatgccccttatgacctgggctacacacgtgctacaatggacggtacaacgagaagcgaacctgcgaaggcaagcggatctctgaaagccgttctcagttcggactgtaggctgcaactcgcctacacgaagctggaatcgctagtaatcgcggatcagcacgccgcggtgaatacgttcccgggccttgtacacaccgcccgtcacaccatgagagtctgtaacacccaaagccggtgggataacctttataggagtcagccgtctaaggtaggacagatgattagggtgaagtcgtaacaaggtagccgtaggagaacctgcggctggatcacctcctttct

SEQ ID NO: 263 - DNA, 1570 bp, Artificial Sequence
  Lactobacillus_gasseri
tgagagtttgatcctggctcaggacgaacgctggcggcgtgcctaatacatgcaagtcgagcgagcttgcctagatgaatttggtgcttgcaccagatgaaactagatacaagcgagcggcggacgggtgagtaacacgtgggtaacctgcccaagagactgggataacacctggaaacagatgctaataccggataacaacactagacgcatgtctagagtttaaaagatggttctgctatcactcttggatggacctgcggtgcattagctagttggtaaggtaacggcttaccaaggcaatgatgcatagccgagttgagagactgatcggccacattgggactgagacacggcccaaactcctacgggaggcagcagtagggaatcttccacaatggacgcaagtctgatggagcaacgccgcgtgagtgaagaagggtttcggctcgtaaagctctgttggtagtgaagaaagatagaggtagtaactggcctttatttgacggtaattacttagaaagtcacggctaactacgtgccagcagccgcggtaatacgtaggtggcaagcgttgtccggatttattgggcgtaaagcgagtgcaggcggttcaataagtctgatgtgaaagccttcggctcaaccggagaattgcatcagaaactgttgaacttgagtgcagaagaggagagtggaactccatgtgtagcggtggaatgcgtagatatatggaagaacaccagtggcgaaggcggctctctggtctgcaactgacgctgaggctcgaaagcatgggtagcgaacaggattagataccctggtagtccatgccgtaaacgatgagtgctaagtgttgggaggtttccgcctctcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccagtgcaaacctaagagattaggtgttcccttcggggacgctgagacaggtggtgcatggctgtcgtcagctcgtgtcgtgagatgttgggttaagtcccgcaacgagcgcaacccttgtcattagttgccatcattaagttgggcactctaatgagactgccggtgacaaaccggaggaaggtggggatgacgtcaagtcatcatgccccttatgacctgggctacacacgtgctacaatggacggtacaacgagaagcgaacctgcgaaggcaagcggatctctgaaagccgttctcagttcggactgtaggctgcaactcgcctacacgaagctggaatcgctagtaatcgcggatcagcacgccgcggtgaatacgttcccgggccttgtacacaccgcccgtcacaccatgagagtctgtaacacccaaagccggtgggataacctttataggagtcagccgtctaaggtaggacagatgattagggtgaagtcgtaacaaggtagccgtaggagaacctgcggctggatcacctcctttct

SEQ ID NO: 264 - DNA, 1571 bp, Artificial Sequence
  Lactobacillus_gasseri
tgagagtttgatcctggctcaggacgaacgctggcggcgtgcctaatacatgcaagtcgagcgagcttgcctagatgaatttggtgcttgcaccaaatgaaactagatacaagcgagcggcggacgggtgagtaacacgtgggtaacctgcccaagagactgggataacacctggaaacagatgctaataccggataacaacactagacgcatgtctagagtttaaaagatggttctgctatcactcttggatggacctgcggtgcattagctagttggtaaggtaacggcttaccaaggcaatgatgcatagccgagttgagagactgatcggccacattgggactgagacacggcccaaactcctacgggaggcagcagtagggaatcttccacaatggacgcaagtctgatggagcaacgccgcgtgagtgaagaagggtttcggctcgtaaagctctgttggtagtgaagaaagatagaggtagtaactggcctttatttgacggtaattacttagaaagtcacggctaactacgtgccagcagccgcggtaatacgtaggtggcaagcgttgtccggatttattgggcgtaaagcgagtgcaggcggttcaataagtctgatgtgaaagccttcggctcaaccggagaattgcatcagaaactgttgaacttgagtgcagaagaggagagtggaactccatgtgtagcggtggaatgcgtagatatatggaagaacaccagtggcgaaggcggctctctggtctgcaactgacgctgaggctcgaaagcatgggtagcgaacaggattagataccctggtagtccatgccgtaaacgatgagtgctaagtgttgggaggtttccgcctctcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccagtgcaaacctaagagattaggagttcccttcggggacgctgagacaggtggtgcatggctgtcgtcagctcgtgtcgtgagatgttgggttaagtcccgcaacgagcgcaacccttgtcattagttgccatcattaagttgggcactctaatgagactgccggtgacaaaccggaggaaggtggggatgacgtcaagtcatcatgccccttatgacctgggctacacacgtgctacaatggacggtacaacgagaagcgaacctgcgaaggcaagcggatctctgaaagccgttctcagttcggactgtaggctgcaactcgcctacacgaagctggaatcgctagtaatcgcggatcagcacgccgcggtgaatacgttcccgggccttgtacacaccgcccgtcacaccatgagagtctgtaacacccaaagccggtgggataacctttataggagtcagccgtctaaggtaggacagatgattagggtgaagtcgtaacaaggtagccgtaggagaacctgcggctggatcacctcctttcta

SEQ ID NO: 265 - DNA, 1327 bp, Artificial Sequence
  Lactobacillus_gasseri
gagtttgatcctggctcaggacgaacgctggcggcgtgcctaatacatgcaagtcgagcgagcggcggacgggtgagtaacacgtgggtaacctgcccaagagactgggataacacctggaaacagatgctaataccggataacaaaagtcactcttggatggacctgcggtgcattagctagttggtaaggtaacggcttaccaaggcaatgatgcatagccgagttgagagactgatcggccacattgggactgagacacggcccaaactcctacgggaggcagcagtagggaatcttccacaatggacgcaagtctgatggagcaacgccgcgtgagtgaagaagggtttcggctcgtaaagctctgttggtagtgaagatgacggtaattacttagaaagtcacggctaactacgtgccagcagccgcggtaatacgtaggtggcaagcgttgtccggatttattgggcgtaaagcgagtgcaggcggttcaataagtctgatgtgaaagccttcggctcaaccggagaattgcatcagaaactgttgaacttgagtgcagaagaggagagtggaactccatgtgtagcggtggaatgcgtagatatatggaagaacaccagtggcgaaggcggctctctggtctgactgacgctgaggctcgaaagcatgggtagcgaacaggattagataccctggtagtccatgccgtaaacgatgagtgctaagtgttgggatctcagtgctgcagctaacgcattaagcactccgcctggggagcacgaccgcaaggttgaaactcaaaggaattgacgggggcccgcacaagcggtggagcatgtggtttaattcgaagcaacgcgaagaaccttaccaggtcttgacatcgacaggtggtgcatggctgtcgtcagctcgtgtcgtgagatgttgggttaagtcccgcaacgagcgcaacccttgtcattagttgccatcatgggcactctaatgagactgccggtgacaaaccggaggaaggtggggatgacgtcaagtcatcatgccccttatgacctgggctacacacgtgctacaatggacggcaacgagaagcgaacctgcgaaggcaagcggatctctgccgttctcagttcggatgtaggctgcaactcgcctacagaagctggaatcgctagtaatcgcggatcagcacgccgcggtgaatacgttcccgggccttgtacacaccgcccgtcacaccatgagagtctgtaacacccaaagccggtggatagtcagccgtctaaggtaggacagatgattagggtgaagtcgtaacaag

SEQ ID NO: 266 - DNA, 1219 bp, Artificial Sequence
  Lactobacillus_gasseri
agcggcggacgggtgagtaacacgtgggtaacctgcccaagagactgggataacacctggaaacagatgctaataccggataacaaaagtcactcttggatggacctgcggtgcattagctagttggtaaggtaacggcttaccaaggcaatgatgcatagccgagttgagagactgatcggccacattgggactgagacacggcccaaactcctacgggaggcagcagtagggaatcttccacaatggacgcaagtctgatggagcaacgccgcgtgagtgaagaagggtttcggctcgtaaagctctgttggtagtgaagatgacggtaattacttagaaagtcacggctaactacgtgccagcagccgcggtaatacgtaggtggcaagcgttgtccggatttattgggcgtaaagcgagtgcaggcggttcaataagtctgatgtgaaagccttcggctcaaccggagaattgcatcagaaactgttgaacttgagtgcagaagaggagagtggaactccatgtgtagcggtggaatgcgtagatatatggaagaacaccagtggcgaaggcggctctctggtctgactgacgctgaggctcgaaagcatgggtagcgaacaggattagataccctggtagtccatgccgtaaacgatgagtgctaagtgttgggatctcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcgacaggtggtgcatggctgtcgtcagctcgtgtcgtgagatgttgggttaagtcccgcaacgagcgcaacccttgtcattagttgccatcatgggcactctaatgagactgccggtgacaaaccggaggaaggtggggatgacgtcaagtcatcatgccccttatgacctgggctacacacgtgctacaatggacggcaacgagaagcgaacctgcgaaggcaagcggatctctgccgttctcagttcggatgtaggctgcaactcgcctacagaagctggaatcgctagtaatcgcggatcagcacgccgcggtgaatacgttcccgggccttgtacacaccgcccgtcacaccatgagagtctgtaacacccaaagccggtgggta

SEQ ID NO: 267 - DNA, 1420 bp, Artificial Sequence
  Oscillibacter_sp_G2
  misc_feature (72)..(72): n is a, c, g, or t
ggacctggctcaggacgaacgctggcggcgtgcttaacacatgcaagtcgaacggagcacccttgaatgagntttcggycaaaggaaaggaatgcttagtggcggactggtgagtaacgcgtgaggaacctgcctttcagagggggacaacagctggaaacggctgctaataccgcatgacgcattcggatggcatcatctgaatgccaaagatttatcgctgaaagatggcctcgcgtctgattagatagttggcggggtaacggcccaccaagtcgacgatcagtagccggactgagaggttgaccggccacattgggactgagatacggcccagactcctacgggaggcagcagtggggaatattgggcaatgggcgcaagcctgacccagcaacgccgcgtgaaggaagaaggctttcgggttgtaaacttcttttaagagggaagagcagaagacggtacctcttgaataagccacggctaactacgtgccagcagccgcggtaatacgtaggtggcaagcgttgtccggatttactgggtgtaaagggcgtgcagccgggtgygcaagtcagatgtgaaatctcagggctcaaccctgaaactgcatttgaaactgtgygtcttgagtgccggagaggtaatcggaattccttgtgtagcggtgaaatgcgtagatataaggaagaacaccagtggcgaaggcggattactggacggtaactgacggtgaggcgcgaaagcgtggggagcaaacaggattagataccctggtagtccacgctgtaaacgatcaatactaggtgtgcggggactgaccccctgcgtgccggagttaacacaataagtattgcacctggggagtacgatcgcaaggttgaaactcaaaggaattgacgggggcccgcacaagcggtggattatgtggtttaattcgaagcaacgcgagaaccttaccaggtcttgacatcctgctacgagtagagatacatcaggtgcccttcggggaaagcagagacaggtggtgcatggttgtcgtcagctcgtgtcgtgagatgttgggttaagtcccgcaacgagcgcaacccctattgttagttgctacgcaagagcactctagcgagactgccgttgacaaaacggaggaaggtggggacgacgtcaaatcatcatgccccttatgacctgggctacacacgtaatacaatggcggagaacaaagggatgcaaagccgcgaggcagagcgaaccccaaaaagccgtcccagttcggatcgcaggctgcaacccgcctgcgtgaagtcggaatcgctagtaatcgtgggtcagcataccacggtgaatacgttcccgggccttgtacacaccgcccgtcacaccatgagagtcgggaacacccgaagtccgtagcctaacc

SEQ ID NO: 268 - DNA, 1453 bp, Artificial Sequence
  Oscillibacter_valericigenes
gacgaacgctggcggcgtgcttaacacatgcaagtcgaacggagcacccttgattgaggtttcggccaaatgagaggaatgcttagtggcggactggtgagtaacgcgtgaggaacctgcctttcagagggggacaacagttggaaacgactgctaataccgcatgatacatttgggcgacatcgcttgaatgtcaaagatttatcgctgaaagatggcctcgcgtctgattagatagttggtgaggtaacggcccaccaagtcgacgatcagtagccggactgagaggttgaccggccacattgggactgagatacggcccagactcctacgggaggcagcagtggggaatattgggcaatggacgcaagtctgacccagcaacgccgcgtgaaggaagaaggctttcgggttgtaaacttcttttaagggggaagagtagaagacggtaccccttgaataagccacggctaactacgtgccagcagccgcggtaatacgtaggtggcaagcgttgtccggatttactgggtgtaaagggcgtgtagccgggaaggtaagtcagatgtgaaatctgggggctcaacctccaaactgcatttgaaactacttttcttgagtatcggagaggtaatcggaattccttgtgtagcggtgaaatgcgtagatataaggaagaacaccagtggcgaaggcggattactggacgacaactgacggtgaggcgcgaaagcgtggggagcaaacaggattagataccctggtagtccacgctgtaaacgatcaatactaggtgtgcggggactgaccccctgcgtgccgcagttaacacaataagtattgcacctggggagtacgatcgcaaggttgaaactcaaaggaattgacgggggcccgcacaagcggtggattatgtggtttaattcgaagcaacgcgaagaaccttaccaggacttgacatcctactaacgaggtagagatacgtcaggtgcccttcggggaaagtagagacaggtggtgcatggttgtcgtcagctcgtgtcgtgagatgttgggttaagtcccgcaacgagcgcaacccctattgttagttgctacgcaagagcactctagcgagactgccgttgacaaaacggaggaaggtggggacgacgtcaaatcatcatgccccttatgtcctgggctacacacgtaatacaatggcggtcaacagagggatgcaaagccgtgaggtggagcgaacccctaaaagccgtctcagttcggatcgcaggctgcaactcgcctgcgtgaagtcggaatcgctagtaatcgcggatcagaatgccgcggtgaatacgttcccgggccttgtacacaccgcccgtcacaccatgagagtcgggaacacccgaagtccgtagcctaacagcaatgagggcgcggccgaaggtgggtttgataattggggtgg

SEQ ID NO: 269 - DNA, 1534 bp, Artificial Sequence
  Oscillibacter_valericigenes
atttatagagagtttgatcctggctcaggacgaacgctggcggcgtgcttaacacatgcaagtcgaacggagcacccttgattgaggtttcggccaaatgagaggaatgcttagtggcggactggtgagtaacgcgtgaggaacctgcctttcagagggggacaacagttggaaacgactgctaataccgcatgatacatttgggcgacatcgcttgaatgtcaaagatttatcgctgaaagatggcctcgcgtctgattagatagttggtgaggtaacggcccaccaagtcgacgatcagtagccggactgagaggttgaccggccacattgggactgagatacggcccagactcctacgggaggcagcagtggggaatattgggcaatggacgcaagtctgacccagcaacgccgcgtgaaggaagaaggctttcgggttgtaaacttcttttaagggggaagagtagaagacggtaccccttgaataagccacggctaactacgtgccagcagccgcggtaatacgtaggtggcaagcgttgtccggatttactgggtgtaaagggcgtgtagccgggaaggtaagtcagatgtgaaatctgggggctcaacctccaaactgcatttgaaactacttttcttgagtatcggagaggtaatcggaattccttgtgtagcggtgaaatgcgtagatataaggaagaacaccagtggcgaaggcggattactggacgacaactgacggtgaggcgcgaaagcgtggggagcaaacaggattagataccctggtagtccacgctgtaaacgatcaatactaggtgtgcggggactgaccccctgcgtgccgcagttaacacaataagtattgcacctggggagtacgatcgcaaggttgaaactcaaaggaattgacgggggcccgcacaagcggtggattatgtggtttaattcgaagcaacgcgaagaaccttaccaggacttgacatcctactaacgaggtagagatacgtcaggtgcccttcggggaaagtagagacaggtggtgcatggttgtcgtcagctcgtgtcgtgagatgttgggttaagtcccgcaacgagcgcaacccctattgttagttgctacgcaagagcactctagcgagactgccgttgacaaaacggaggaaggtggggacgacgtcaaatcatcatgccccttatgtcctgggctacacacgtaatacaatggcggtcaacagagggatgcaaagccgtgaggtggagcgaacccctaaaagccgtctcagttcggatcgcaggctgcaactcgcctgcgtgaagtcggaatcgctagtaatcgcggatcagaatgccgcggtgaatacgttcccgggccttgtacacaccgcccgtcacaccatgagagtcgggaacacccgaagtccgtagcctaacagcaatgagggcgcggccgaaggtgggtttgataattggggtgaagtcgtaacaaggtagccgtatcggaaggtgcggctggatcacctcctttcta

SEQ ID NO: 270 - DNA, 1450 bp, Artificial Sequence
  Oscillospira_guilliermondii
gacgaacgctggcggcgtgcttaacacatgcaagtcgaacggagcgccaaggaaggagttttcggacaacggatttggctgcttagtggcggactggtgagtaacgcgtgaggaacctgcccttgagtgggggacaacggttggaaacgactgctaataccgcatgatgtattgtcgggacatcccggcgataccaaagatttatcgctcaaggatggcctcgcgtctgattagatagttggtgaggtaacggctcaccaagtcgacgatcagtagccggactgagaggttggccggccacattgggactgagatacggcccagactcctacgggaggcagcagtggggaatattgggcaatggacgcaagtctgacccagcaacgccgcgtgaaggaagaaggctttcgggttgtaaacttcttttaagggggaagagcagaagacggtaccccttgaataagccacggctaactacgtgccagcagccgcggtaatacgtaggtggcgagcgttgtccggatttactgggtgtaaagggcgtgcagccgggtctgcaagtcagatgtgaaatccacgggcttaacccgtgaactgcatttgaaactgcgggtcttgagtatcggagaggtaatcggaattcctggtgtagcggtgaaacgcgtagatatcaggaagaacaccagtggcgaaggcggattactggacgacaactgacggtgaggcgcgaaagcgtggggagcaaacaggattagataccctggtagtccacgctgtaaacgatcaatactaggtgtgcggggactaacccctcgcgtgccggagtcaacacaataagtattgcacctggggagtacgatcgcaaggttgaaactcaaaggaattgacgggggcccgcacaagcggtggattatgtggtttaattcgaagcaacgcgaagaaccttaccaaggcttgacatggagaggctcggcttagagataggtctttcccttcggggacttctcacacaggtggtgcatggttgtcgtcagctcgtgtcgtgagatgttgggttaagtcccgcaacgagcgcaacccctattgttagttgctacgcaagagcactctagcgagactgccgttgacaaaacggaggaaggtggggacgacgtcaaatcatcatgccccttatgtcttgggctacacacgtaatacaatggcggatacaaagggatgcgaaaccgcgaggtggagcgaaccccgaaaagccgtctcagttcggatcgcaggctgcaacccgcctgcgtgaagtcggaatcgctagtaatcgtgggtcagcataccacggtgaatacgttcccgggccttgtacacaccgcccgtcacaccatgagagtcgggaacacccgaagtccgtagcctaaccgcaaggggggcgcggccgaaggtgggttcgataattggggtg

SEQ ID NO: 271 - DNA, 1491 bp, Artificial Sequence
  Papillibacter_cinnamivorans
  misc_feature (449)..(449): n is a, c, g, or t
  misc_feature (454)..(454): n is a, c, g, or t
  misc_feature (589)..(589): n is a, c, g, or t
  misc_feature (1427)..(1427): n is a, c, g, or t
gatcctggctcaggacgaacgctggcggcgtgcctaacacatgcaagtcgaacgaaaataccaaagcagcaatgcgggggtattttagtggcggacgggtgagtaacgcgtgagcaatctgccttttggagggggataccgactggaaacggtcgttaataccgcataacgtatatggacgacatcgtccgtataccaaaggagcaatccgccgaaagatgagctcgcgtctgattagctagttggcggggtaaaggcccaccaaggcgacgatcagtagccggactgagaggttgaacggccacattgggactgagatacggcccagactcctacgggaggcagcagtggggaatattgggcaatgggcgaaagcctgacccagcaacgccgcgtcaaggaagaaggccttcgggttgtaaacttcttttaccagggaagaagaagtncggtncctggaaaacaagccacggctatctacgtgccagcagccgcggtaatacgtaggtggcaagcgttgtccggatttactgggtgtaaagggcgcgtaggcggcattgcaagtcagatgtgaaatgccggggcttanccccggagctgcatttgaaactgtagagcttgagtgatggagaggcaggcggaattcctagtgtagcggtgaaatgcgtagatattaggaggaacaccagtggcgaaggcggcctgctggacattaactgacgctgaggcgcgaaagcgtggggagcaaacaggattagataccctggtagtccacgctgtaaacgatggatactaggtgtgggaggtctgaccccttccgtgccggagttaacacaataagtatcccacctggggagtacgatcgcaaggttgaaactcaaaggaattgacgggggcccgcacaagcagtggagtatgtggtttaattcgaagcaacgcgaagaaccttaccaggatttgacatcctactaacgaggtagagatacgtcaggtgcccttcggggaaagtagagacaggtggtgcatggttgtcgtcagctcgtgtcgtgagatgttgggttaagtcccgcaacgagcgcaacccttattgctagttgctacgcaagagcactctagcgagactgccgttgacaaaacggaggaaggcggggacgacgtcaaatcatcatgccccttatgtcctgggctacacacgtactacaatggcggttaacagagggaagcaagacagtgatgtggagcaaatccctaaaaaccgtctcagttcggatcgcaggctgcaacccgcctgcgtgaagtcggaattgctagtaatcgcggatcagcatgccgcggtgaatacgttcccgggccttgtacacaccgcccgtcacaccatgagagtcgggaatacccgaagtccgtagtctaaccgcaagggggacgcngccgaaggtaggttcgataattggggtgaagtcgtaacaaggtaaccgtatcggaaggtgcggc

SEQ ID NO: 272 - DNA, 1497 bp, Artificial Sequence
  Parabacteroides_distasonis
caatttaaacaacgaagagtttgatcctggctcaggatgaacgctagcgacaggcttaacacatgcaagtcgaggggcagcggggtgtagcaatacaccgccggcgaccggcgcacgggtgagtaacgcgtatgcaacttgcctatcagagggggataacccggcgaaagtcggactaataccgcatgaagcagggatcccgcatgggaatatttgctaaagattcatcgctgatagataggcatgcgttccattaggcagttggcggggtaacggcccaccaaaccgacgatggataggggttctgagaggaaggtcccccacattggtactgagacacggaccaaactcctacgggaggcagcagtgaggaatattggtcaatgggcgtaagcctgaaccagccaagtcgcgtgagggatgaaggttctatggatcgtaaacctcttttataagggaataaagtgcgggacgtgtcccgttttgtatgtaccttatgaataaggatcggctaactccgtgccagcagccgcggtaatacggaggatccgagcgttatccggatttattgggtttaaagggtgcgtaggcggccttttaagtcagcggtgaaagtctgtggctcaaccatagaattgccgttgaaactggggggcttgagtatgtttgaggcaggcggaatgcgtggtgtagcggtgaaatgcatagatatcacgcagaaccccgattgcgaaggcagcctgccaagccattactgacgctgatgcacgaaagcgtggggatcaaacaggattagataccctggtagtccacgcagtaaacgatgatcactagctgtttgcgatacactgtaagcggcacagcgaaagcgttaagtgatccacctggggagtacgccggcaacggtgaaactcaaaggaattgacgggggcccgcacaagcggaggaacatgtggtttaattcgatgatacgcgaggaaccttacccgggtttgaacgcattcggaccgaggtggaaacaccttttctagcaatagccgtttgcgaggtgctgcatggttgtcgtcagctcgtgccgtgaggtgtcggcttaagtgccataacgagcgcaacccttgccactagttactaacaggttaggctgaggactctggtgggactgccagcgtaagctgcgaggaaggcggggatgacgtcaaatcagcacggcccttacatccggggcgacacacgtgttacaatggcgtggacaaagggaggccacctggcgacagggagcgaatccccaaaccacgtctcagttcggatcggagtctgcaacccgactccgtgaagctggattcgctagtaatcgcgcatcagccatggcgcggtgaatacgttcccgggccttgtacacaccgcccgtcaagccatgggagccgggggtacctgaagtccgtaaccgcgaggatcggcctagggtaaaactggtgactggggctaagtcgtaacaag

SEQ ID NO: 273 - DNA, 1323 bp, Artificial Sequence
  Parabacteroides_distasonis
gagtttgatcctggctcaggatgaacgctagcgacaggcttaacacatgcaagtcgagggaccggcgcacgggtgagtaacgcgtatgcaacttacctatcagagggggataacccggcgaaagtcggactaataccgcatgaataaagtcgctgatagataggcatgcgttccattaggcagttggcggggtaacggcccaccaaaccgacgatggataggggttctgagaggaaggtcccccacattggtactgagacacggaccaaactcctacgggaggcagcagtgaggaatattggtcaatgggcgtaagcctgaaccagccaagtcgcgtgagggatgaaggtttatggatcgtaaacctcttttataagggaatatgtatgtaccttatgaataaggatcggctaactccgtgccagcagccgcggtaatacggaggatccgagcgttatccggatttattgggtttaaagggtgcgtaggcggccttttaagtcagcggtgaaagtctgtggctcaaccatagaattgccgttgaaactgggaggcttgagtatgtttgaggcaggcggaatgcgtggtgtagcggtgaaatgcttagatatcacgcagaaccccgattgcgaaggcagcctgccaagccaactgacgctgatgcacgaaagcgtggggatcaaacaggattagataccctggtagtccacgcagtaaacgatgatcactagctgtttgcgtgtaagcggcacagcgaaagcgttaagtgatccacctggggagtacgccggcaacggtgaaactcaaaggaattgacgggggcccgcacaagcggaggaacatgtggtttaattcgatgatacgcgaggaaccttacccgggtttgaacgcgcgaggtgctgcatggttgtcgtcagctcgtgccgtgaggtgtcggcttaagtgccataacgagcgcaacccttgccactagttactaacagctgaggactctggtgggactgccagcgtaagctggaggaaggcggggatgacgtcaaatcagcacggcccttacatccggggcgacacacgtgttacaatggcgtgcaaagggaggccacctggcgacagggagcgaatcccccacgtctcagttcggacggagtctgcaacccgactccggaagctggattcgctagtaatcgcgcatcagccatggcgcggtgaatacgttcccgggccttgtacacaccgcccgtcaagccatgggagccgggggtacctgaagtccgtatcggcctagggtaaaactggtgactggggctaagtcgtaacaaggta

SEQ ID NO: 274 - DNA, 1486 bp, Artificial Sequence
  Parabacteroides_distasonis
agagtttgatcctggctcaggatgaacgctagcgacaggcttaacacatgcaagtcgaggggcagcacaggtagcaatacccgccggcgaccggcgcacgggtgagtaacgcgtatgcaacttgcctatcagagggggataacccggcgaaagtcggactaataccgcatgaagcaggggccccgcatggggatatttgctaaagattcatcgctgatagataggcatgcgttccattaggcagttggcggggtaacggcccaccaaaccgacgatggataggggttctgagaggaaggtcccccacattggtactgagacacggaccaaactcctacgggaggcagcagtgaggaatattggtcaatgggcgtaagcctgaaccagccaagtcgcgtgagggatgaaggttctatggatcgtaaacctcttttataagggaataaagtgtgggacgtgtcctgttttgtatgtaccttatgaataaggatcggctaactccgtgccagcagccgcggtaatacggaggatccgagcgttatccggatttattgggtttaaagggtgcgtaggcggccttttaagtcagcggtgaaagtctgtggctcaaccatagaattgccgttgaaactgggaggcttgagtatgtttgaggcaggcggaatgcgtggtgtagcggtgaaatgcttagatatcacgcagaaccccgattgcgaaggcagcctgccaagccatgactgacgctgatgcacgaaagcgtggggatcaaacaggattagataccctggtagtccacgcagtaaacgatgatcactagctgtttgcgatacactgtaagcggcacagcgaaagcgttaagtgatccacctggggagtacgccggcaacggtgaaactcaaaggaattgacgggggcccgcacaagcggaggaacatgtggtttaattcgatgatacgcgaggaaccttacccgggtttgaacgcattcggaccgaggtggaaacaccttttctagcaatagccgtttgcgaggtgctgcatggttgtcgtcagctcgtgccgtgaggtgtcggcttaagtgccataacgagcgcaacccttgccactagttactaacaggtgatgctgaggactctggtgggactgccagcgtaagctgcgaggaaggcggggatgacgtcaaatcagcacggcccttacatccggggcgacacacgtgttacaatggcgtggacaaagggatgccacctggcgacagggagcgaatccccaaaccacgtctcagttcggatcggagtctgcaacccgactccgtgaagctggattcgctagtaatcgcgcatcagccatggcgcggtgaatacgttcccgggccttgtacacaccgcccgtcaagccatgggagccgggggtacctgaagtccgtaaccgaaaggatcggcctagggtaaaactggtgactggggctaagtcgtaacaaggtaacc

SEQ ID NO: 275 - DNA, 1486 bp, Artificial Sequence
  Parabacteroides_distasonis
agagtttgatcctggctcaggatgaacgctagcgacaggcttaacacatgcaagtcgaggggcagcacaggtagcaataccgggtggcgaccggcgcacgggtgagtaacgcgtatgcaacttacctatcagagggggataacccggcgaaagtcggactaataccgcatgaagcaggggccccgcatggggatatttgctaaagattcatcgctgatagataggcatgcgttccattaggcagttggcggggtaacggcccaccaaaccgacgatggataggggttctgagaggaaggtcccccacattggtactgagacacggaccaaactcctacgggaggcagcagtgaggaatattggtcaatgggcgtaagcctgaaccagccaagtcgcgtgagggatgaaggttctatggatcgtaaacctcttttataagggaataaagtgcgggacgtgtcccgttttgtatgtaccttatgaataaggatcggctaactccgtgccagcagccgcggtaatacggaggatccgagcgttatccggatttattgggtttaaagggtgcgtaggcggccttttaagtcagcggtgaaagtctgtggctcaaccatagaattgccgttgaaactgggaggcttgagtatgtttgaggcaggcggaatgcgtggtgtagcggtgaaatgcttagatatcacgcagaaccccgattgcgaaggcagcctgccaagccatgactgacgctgatgcacgaaagcgtggggatcaaacaggattagataccctggtagtccacgcagtaaacgatgatcactagctgtttgcgatacactgtaagcggcacagcgaaagcgttaagtgatccacctggggagtacgccggcaacggtgaaactcaaaggaattgacgggggcccgcacaagcggaggaacatgtggtttaattcgatgatacgcgaggaaccttacccgggtttgaacgcattcggaccgaggtggaaacaccttttctagcaatagccgtttgcgaggtgctgcatggttgtcgtcagctcgtgccgtgaggtgtcggcttaagtgccataacgagcgcaacccttgccactagttactaacaggtaaagctgaggactctggtgggactgccagcgtaagctgcgaggaaggcggggatgacgtcaaatcagcacggcccttacatccggggcgacacacgtgttacaatggcgtggacaaagggaggccacctggcgacagggagcgaatccccaaaccacgtctcagttcggatcggagtctgcaacccgactccgtgaagctggattcgctagtaatcgcgcatcagccatggcgcggtgaatacgttcccgggccttgtacacaccgcccgtcaagccatgggagccgggggtacctgaagtccgtaaccgaaaggatcggcctagggtaaaactggtgactggggctaagtcgtaacaaggtaacc

SEQ ID NO: 276 - DNA, 1486 bp, Artificial Sequence
  Parabacteroides_distasonis
agagtttgatcctggctcaggatgaacgctagcgacaggcttaacacatgcaagtcgaggggcagcacaggtagcaataccgggtggcgaccggcgcacgggtgagtaacgcgtatgcaacttacctatcagagggggataacccggcgaaagtcggactaataccgcatgaagcaggggccccgcatggggatatttgctaaagattcatcgctgatagataggcatgcgttccattaggcagttggcggggtaacggcccaccaaaccgacgatggataggggttctgagaggaaggtcccccacattggtactgagacacggaccaaactcctacgggaggcagcagtgaggaatattggtcaatgggcgtaagcctgaaccagccaagtcgcgtgagggatgaaggttctatggatcgtaaacctcttttataagggaataaagtgtgggacgtgtcccgttttgtatgtaccttatgaataaggatcggctaactccgtgccagcagccgcggtaatacggaggatccgagcgttatccggatttattgggtttaaagggtgcgtaggcggccttttaagtcagcggtgaaagtctgtggctcaaccatagaattgccgttgaaactgggaggcttgagtatgtttgaggcaggcggaatgcgtggtgtagcggtgaaatgcttagatatcacgcagaaccccgattgcgaaggcagcctgccaagccatgactgacgctgatgcacgaaagcgtggggatcaaacaggattagataccctggtagtccacgcagtaaacgatgatcactagctgtttgcgatacattgtaagcggcacagcgaaagcgttaagtgatccacctggggagtacgccggcaacggtgaaactcaaaggaattgacgggggcccgcacaagcggaggaacatgtggtttaattcgatgatacgcgaggaaccttacccgggtttgaacgcattcggaccgaggtggaaacaccttttctagcaatagccgtttgcgaggtgctgcatggttgtcgtcagctcgtgccgtgaggtgtcggcttaagtgccataacgagcgcaacccttgccactagttactaacaggtaaagctgaggactctggtgggactgccagcgtaagctgcgaggaaggcggggatgacgtcaaatcagcacggcccttacatccggggcgacacacgtgttacaatggcgtggacaaagggaggccacctggcgacagggagcgaatccccaaaccacgtctcagttcggatcggagtctgcaacccgactccgtgaagctggattcgctagtaatcgcgcatcagccatggcgcggtgaatacgttcccgggccttgtacacaccgcccgtcaagccatgggagccgggggtacctgaagtccgtaaccgaaaggatcggcctagggtaaaactggtgactggggctaagtcgtaacaaggtaacc

SEQ ID NO: 277 - DNA, 1493 bp, Artificial Sequence
  Parabacteroides_distasonis
  misc_feature (815)..(815): n is a, c, g, or t
  misc_feature (848)..(849): n is a, c, g, or t
  misc_feature (904)..(904): n is a, c, g, or t
aggatgaacgctcagcgacaggcttaacacatgcaagtcgaggggcagcgggggtagcaatacccgccggcgaccggcgcacgggtgagtaacgcgtatgcaacttacctatcagagggggataacccggcgaaagtcggactaataccgcatgaagcaggggtcccgcatggggatatttgctaaagattcatcgctgatagataggcatgcgttccattaggcagttggcggggtaacggcccaccaaaccgacgatggatagggttctgagaggaaggtcccccacattggtactgagacacggaccaaactcctacgggaggcagcagtgaggaatattggtcaatgggcgtgagcctgaaccagccaagtcgcgtgagggatgaaggttctatggatcgtaaacctcttttataagggaataaagtgtgggacgtgtcctattttgtatgtaccttatgaataaggatcagccaactccgtgccatgcagccgcggtaatacggaggatccgagcgttatccggatttattgggtttaaagggtgcgtaggcggccttttaagtcagcggtgaaagtctgtggctcaaccatagaattgccgttgaaactggggggcttgagtatgtttgaggcaggcggaatgcgtggtgtagcggtgaaatgcatagatatcacgcagaaccccgattgcgaaggcagcctgccaagccattactgacgctgatgcacgagcgtgggggatccaaccaaggagttaaatcccctggtagtccccccattaaaccgaataatcctaacctgktttgscnaatacccytgkttagccgggmccaaccraaaannctttaaatttatcccmccckgggaattmcccccggmacggkttaaaacyccaaangaatttkacgggggcccccccaakccgaaagaactttttgkttaattcgatgatacgcgaggaaccttacccgggtttgaacgcattcggaccgaggtggaaacaccttttctagcaatagccgtttgcgaggtgctgcatggttgtcgtcagctcgtgccgtgaggtgtcggcttaagtgccataacgagcgcaacccttgccactagttactaacaggtgatgctgaggactctggtgggactgccagcgtaactgcgaagaagcggggatgacgtcaaatcagcacgggcccttacatccggggcgacacacgtgttacaatggcgtggacaaagggagccacctggcgacagggagcgaatccccaaaccacgtctcagttcggatcggagtctgcaacccgactccgtgaagctggattcgctagtaatcgcgcatcagccatggcgcggtgaatacgttcccgggccttgtacacaccgcccgtcaagccatgggagccgggggtacctgaagtccgtaaccgagaggatcggcctagggtaaaactggtgactggggctaagtygtaacaaggtarcygtam

SEQ ID NO: 278 - DNA, 1442 bp, Artificial Sequence
  Parabacteroides_distasonis
ggtagcaataccgggtggcgaccggcgcacgggtgagtaacgcgtatgcaacttacctatcagagggggataacccggcgaaagtcggactaataccgcatgaagcaggggccccgcatggggatatttgctaaagattcatcgctgatagataggcatgcgttccattaggcagttggcggggtaacggcccaccaaaccgacgatggataggggttctgagaggaaggtcccccacattggtactgagacacggaccaaactcctacgggaggcagcagtgaggaatattggtcaatgggcgtaagcctgaaccagccaagtcgcgtgagggatgaaggttctatggatcgtaaacctcttttataagggaataaagtgcgggacgtgtcccgttttgtatgtaccttatgaataaggatcggctaactccgtgccagcagccgcggtaatacggaggatccgagcgtacggatttattgggtttaagggtgcgtaggcggccttttaagtcagcggtgaaagtctgtggctcaaccatagaattgccgttgaaactggggggcttgagtatgtttgaggcaggcggaatgcgtggtgtagcggtgaaatgcttagatatcacgcagaaccccgattgcgaaggcagcctgccaagccatgactgacgctgatgcacgaaagcgtggggatcaaacaggattagataccctggtagtccacgcagtaaacgatgatcactagctgtttgcgatacactgtaagcggcacagcgaaagcgttaagtgatccacctggggagtacgccggcaacggtgaaactcaaaggaattgacgggggcccgcacaagcggaggaacatgtggtttaattcgatgatacgcgaggaaccttacccgggtttgaacgcattcggaccgaggtggaaacaccttttctagcaatagccgtttgcgaggtgctgcatggttgtcgtcagctcgtgccgtgaggtgtcggcttaagtgccataacgagcgcaacccttgccactagttactaacaggtaaagctgaggactctggtgggactgccagcgtaagctgcgaggaaggcggggatgacgtcaaatcagcacggcccttacatccggggcgacacacgtgttacaatggcgtggacaaagggatgccacctggcgacagggagcgaatccccaaaccacgtctcagttcggatcggagtctgcaacccgactccgtgaagctggattcgctagtaatcgcgcatcagccatggcgcggtgaatacgttcccgggccttgtacacaccgcccgtcaagccatgggagccgggggtacctgaagtccgtaaccgcgaggatcggcctagggtaaaactggtgactggggctaagtcgtaacaagtagcgtccggagcgcggaacactctctagactgca

SEQ ID NO: 279 - DNA, 1396 bp, Artificial Sequence
  Parabacteroides_goldsteinii
gtcgaggggcagcacggatgtagcaatacattggtggcgaccggcgcacgggtgagtaacgcgtatgcaacctgcctatcagaggggaataacccggcgaaagtcggactaataccgcataaaacaggggttccacatggaaatatttgttaaagaattatcgctgatagatgggcatgcgttccattagatagttggtgaggtaacggctcaccaagtccacgatggataggggttctgagaggaaggtcccccacactggtactgagacacggaccagactcctacgggaggcagcagtgaggaatattggtcaatgggcgagagcctgaaccagccaagtcgcgtgaaggatgaaggatctatggtttgtaaacttcttttatatgggaataaagtgaggaacgtgttcctttttgtatgtaccatatgaataagcatcggctaactccgtgccagcagccgcggtaatacggaggatgcgagcgttatccggatttattgggtttaaagggtgcgtaggtggttaattaagtcagcggtgaaagtttgtggctcaaccataaaattgccgttgaaactggttgacttgagtatatttgaggtaggcggaatgcgtggtgtagcggtgaaatgcatagatatcacgcagaactccgattgcgaaggcagcttactaaactataactgacactgaagcacgaaagcgtggggatcaaacaggattagataccctggtagtccacgcagtaaacgatgattactagctgtttgcgatacacagtaagcggcacagcgaaagcgttaagtaatccacctggggagtacgccggcaacggtgaaactcaaaggaattgacgggggcccgcacaagcggaggaacatgtggtttaattcgatgatacgcgaggaaccttacccgggtttgaacgcattatgacagctctggaaacacattctctagtaatagcaatttgcgaggtgctgcatggttgtcgtcagctcgtgccgtgaggtgtcggcttaagtgccataacgagcgcaacccttatcactagttactaacaggtcaagctgaggactctagtgagactgccagcgtaagctgtgaggaaggtggggatgacgtcaaatcagcacggcccttacatccggggcgacacacgtgttacaatggtggggacaaagggcagctacctggcgacaggatgctaatctccaaaccccatctcagttcggatcgaagtctgcaacccgacttcgtgaagctggattcgctagtaatcgcgcatcagccatggcgcggtgaatacgttcccgggccttgtacacaccgcccgtcaagccatgggagttgggggtacctaaagtccgtaaccgcaaggatcggcctagg

SEQ ID NO: 280 - DNA, 1325 bp, Artificial Sequence
  Parabacteroides_gordonii
gagtttgatcctggctcaggatgaacgctagcgacaggcttaacacatgcaagtcgagggaccggcgcacgggtgagtaacgcgtatgcaacctacctatcagagggggataacccggcgaaagtcggactaataccgcataaataaagttgctgatagatgggcatgcgttccattagatagttggtaaggtaacggcttaccaagtctgcgatggataggggttctgagaggaaggtcccccacactggtactgagacacggaccagactcctacgggaggcagcagtgaggaatattggtcaatgggcgagagcctgaaccagccaagtcgcgtgaaggatgaaggattatggttcgtaaacttcttttataagggaatatgtatgtaccttatgaataaggatcggctaactccgtgccagcagccgcggtaatacggaggatccgagcgttatccggatttattgggtttaaagggtgcgtaggtggtttattaagtcagcggtgaaagtttgtggctcaaccataaaattgccgttgaaactggttaacttgagtatatttgaggtaggcggaatgcgtggtgtagcggtgaaatgcatagatatcacgcagaactccaattgcgaaggcagcttactaaactaactgacactgaagcacgaaagcgtggggatcaaacaggattagataccctggtagtccacgcagtaaacgatgattactaggagtttgcgagtaagctctacagcgaaagcgttaagtaatccacctggggagtacgccggcaacggtgaaactcaaaggaattgacgggggcccgcacaagcggaggaacatgtggtttaattcgatgatacgcgaggaaccttacccgggtttgaacgcgcgaggtgctgcatggttgtcgtcagctcgtgccgtgaggtgtcggcttaagtgccataacgagcgcaacccttatctttagttactaacagctgaggactctaaagagactgccagcgtaagctggaggaaggtggggatgacgtcaaatcagcacggcccttacatccggggcgacacacgtgttacaatggtgggcaaagggcagctacacagcgatgtgatgctaatctcccccatctcagttcggacgaagtctgcaacccgacttcggaagctggattcgctagtaatcgcgcatcagccatggcgcggtgaatacgttcccgggccttgtacacaccgcccgtcaagccatgggagttgggggtacctaaagtccgtatcggcctaggtaaaaccgatgactggggctaagtcgtaacaaggtaacc

SEQ ID NO: 281 - DNA, 1326 bp, Artificial Sequence
  Parabacteroides_gordonii
gagtttgatcctggctcaggatgaacgctagcgacaggcttaacacatgcaagtcgagggaccggcgcacgggtgagtaacgcgtatgcaacctacctatcagagggggataacccggcgaaagtcggactaataccgcataaataaagttgctgatagatgggcatgcgttccattagatagttggtaaggtaacggcttaccaagtctgcgatggataggggttctgagaggaaggtcccccacactggtactgagacacggaccagactcctacgggaggcagcagtgaggaatattggtcaatgggcgagagcctgaaccagccaagtcgcgtgaaggatgaaggattatggttcgtaaacttcttttataagggaatatgtatgtaccttatgaataaggatcggctaactccgtgccagcagccgcggtaatacggaggatccgagcgttatccggatttattgggtttaaagggtgcgtaggtggtttattaagtcagcggtgaaagtttgtggctcaaccataaaattgccgttgaaactggttaacttgagtatatttgaggtaggcggaatgcgtggtgtagcggtgaaatgcatagatatcacgcagaactccaattgcgaaggcagcttactaaactaactgacactgaagcacgaaagcgtggggatcaaacaggattagataccctggtagtccacgcagtaaacgatgattactaggagtttgcgagtaagctctacagcgaaagcgttaagtaatccacctggggagtacgccggcaacggtgaaactcaaaggaattgacgggggcccgcacaagcggaggaacatgtggtttaattcgatgatacgcgaggaaccttacccgggtttgaacgcgcgaggtgctgcatggttgtcgtcagctcgtgccgtgaggtgtcggcttaagtgccataacgagcgcaacccttatctttagttactaacagctgaggactctaaagagactgccagcgtaagctggaggaaggtggggatgacgtcaaatcagcacggcccttacatccggggcgacacacgtgttacaatggtgggcaaagggcagctacacagcgatgtgatgctaatctcccccatctcagttcggacgaagtctgcaacccgacttcggaagctggattcgctagtaatcgcgcatcagccatggcgcggtgaatacgttcccgggccttgtacacaccgcccgtcaagccatgggagttgggggtacctaaagtccgtatcggcctagggtaaaaccgatgactggggctaagtcgtaacaaggtaacc

SEQ ID NO: 282 - DNA, 1530 bp, Artificial Sequence
  Parabacteroides_johnsonii
acaacgaagagtttgatcctggctcaggatgaacgctagcgacaggcttaacacatgcaagtcgaggggcagcatggtaagtagcaatacttattgatggcgaccggcgcacgggtgagtaacgcgtatgcaacttacctatcagagggggatagcccggcgaaagtcggattaatactccataaaacaggggttccgcatgggactatttgttaaagattcatcgctgatagataggcatgcgttccattaggcagttggcggggtaacggcccaccaaaccgacgatggataggggttctgagaggaaggtcccccacattggtactgagacacggaccaaactcctacgggaggcagcagtgaggaatattggtcaatggccgagaggctgaaccagccaagtcgcgtgaaggatgaaggatctatggtttgtaaacttcttttataggggaataaagtgtgggacgtgttccattttgtatgtaccctatgaataagcatcggctaactccgtgccagcagccgcggtaatacggaggatgcgagcgttatccggatttattgggtttaaagggtgcgtaggtggtaatttaagtcagcggtgaaagtttgtggctcaaccataaaattgccgttgaaactgggttacttgagtgtgtttgaggtaggcggaatgcgtggtgtagcggtgaaatgcatagatatcacgcagaactccaattgcgaaggcagcttactaaaccataactgacactgaagcacgaaagcgtgggtatcaaacaggattagataccctggtagtccacgcagtaaacgatgattactaggagtttgcgatacacagtaagctctacagcgaaagcgttaagtaatccacctggggagtacgccggcaacggtgaaactcaaaggaattgacgggggcccgcacaagcggaggaacatgtggtttaattcgatgatacgcgaggaaccttacccgggtttgaacgtagtcagaccgaccttgaaagaggttttctagcaatagctgattacgaggtgctgcatggttgtcgtcagctcgtgccgtgaggtgtcggcttaagtgccataacgagcgcaacccttatcactagttactaacaggttaagctgaggactctggtgagactgccagcgtaagctgtgaggaaggtggggatgacgtcaaatcagcacggcccttacatccggggcgacacacgtgttacaatggcatggacaaagggcagctacctggcgacaggatgctaatctctaaaccatgtctcagttcggatcggagtctgcaactcgactccgtgaagctggattcgctagtaatcgcgcatcagccatggcgcggtgaatacgttcccgggccttgtacacaccgcccgtcaagccatgggagccgggggtacctgaagtccgtaaccgcaaggatcggcctagggtaaaactggtgactggggctaagtcgtaacaaggtagccgtaccggaaggtgcggctggaacacctcctt

SEQ ID NO: 283 - DNA, 545 bp, Artificial Sequence
  Parabacteroides_merdae
agagtttgatcctggctcaggatgaacgctagcgacaggcttaacacatgcaagtcgaggggcagcatgatttgtagcaatacagattgatggcgaccggcgcacgggtgagtaacgcgtatgcaacttacctatcagagggggatagcccggcgaagtcggattaataccccataaaacaggggtcccgcatgggaatatttgttaaagattcatcgctgatagataggcatgcggtcaaatcagcacggcccttacatccggggcgacacacgtgttacaatggcatggacaaagggcagctacctggcgacaggatgctaatctccaaaccatgtctcagttcggatcggagtctgcaactcgactccgtgaagctggattcgctagtaatcgcgcatcagccatggcgcggtgaatacgttcccgggccttgtacacaccgcccgtcaagccatgggagccgggggtacctgaagtccgtaaccgcaaggatcggcctagggtaaaactggtgactggggctaagtcgtaacaaggtaacc

SEQ ID NO: 284 - DNA, 1326 bp, Artificial Sequence
  Parabacteroides_sp_D13
gagtttgatcctggctcaggatgaacgctagcgacaggcttaacacatgcaagtcgagggaccggcgcacgggtgagtaacgcgtatgcaacttacctatcagagggggatagcccggcgaaagtcggattaataccccataaataaagtcgctgatagataggcatgcgttccattaggcagttggcggggtaacggcccaccaaaccgacgatggataggggttctgagaggaaggtcccccacattggtactgagacacggaccaaactcctacgggaggcagcagtgaggaatattggtcaatggccgagaggctgaaccagccaagtcgcgtgaaggaagaaggattatggtttgtaaacttcttttataggggaatatgtatgtaccctatgaataagcatcggctaactccgtgccagcagccgcggtaatacggaggatgcgagcgttatccggatttattgggtttaaagggtgcgtaggtggtgatttaagtcagcggtgaaagtttgtggctcaaccataaaattgccgttgaaactgggttacttgagtgtgtttgaggtaggcggaatgcgtggtgtagcggtgaaatgcatagatatcacgcagaactccgattgcgaaggcagcttactaaaccaactgacactgaagcacgaaagcgtggggatcaaacaggattagataccctggtagtccacgcagtaaacgatgattactaggagtttgcgtgtaagctctacagcgaaagcgttaagtaatccacctggggagtacgccggcaacggtgaaactcaaaggaattgacgggggcccgcacaagcggaggaacatgtggtttaattcgatgatacgcgaggaaccttacccgggtttgaacgtacgaggtgctgcatggttgtcgtcagctcgtgccgtgaggtgtcggcttaagtgccataacgagcgcaacccttatcactagttactaacagctgaggactctggtgagactgccagcgtaagctggaggaaggtggggatgacgtcaaatcagcacggcccttacatccggggcgacacacgtgttacaatggcatgcaaagggcagctacctggtgacaggatgctaatctcccatgtctcagttcggacggagtctgcaactcgactccggaagctggattcgctagtaatcgcgcatcagccatggcgcggtgaatacgttcccgggccttgtacacaccgcccgtcaagccatgggagccgggggtacctgaagtccgtatcggcctagggtaaaactggtgactggggctaagtcgtaacaaggtaacc

SEQ ID NO: 285 - DNA, 1522 bp, Artificial Sequence
  Parabacteroides_sp_NS31_3
gtttgatcctggctcaggatgaacgctagcgacaggcttaacacatgcaagtcgaggggcagcatgatttgtagcaatacagattgatggcgaccggcgcacgggtgagtaacgcgtatgcaacttacctatcagagggggatagcccggcgaaagtcggattaataccccataaaacaggggtcccgcatgggaatatttgttaaagattcatcgctgatagataggcatgcgttccattaggcagttggcggggtaacggcccaccaaaccgacgatggataggggttctgagaggaaggtcccccacattggtactgagacacggaccaaactcctacgggaggcagcagtgaggaatattggtcaatggccgagaggctgaaccagccaagtcgcgtgaaggaagaaggatctatggtttgtaaacttcttttataggggaataaagtggaggacgtgtccttttttgtatgtaccctatgaataagcatcggctaactccgtgccagcagccgcggtaatacggaggatgcgagcgttatccggatttattgggtttaaagggtgcgtaggtggtgatttaagtcagcggtgaaagtttgtggctcaaccataaaattgccgttgaaactgggttacttgagtgtgtttgaggtaggcggaatgcgtggtgtagcggtgaaatgcatagatatcacgcagaactccgattgcgaaggcagcttactaaaccataactgacactgaagcacgaaagcgtggggatcaaacaggattagataccctggtagtccacgcagtaaacgatgattactaggagtttgcgatacaatgtaagctctacagcgaaagcgttaagtaatccacctggggagtacgccggcaacggtgaaactcaaaggaattgacgggggcccgcacaagcggaggaacatgtggtttaattcgatgatacgcgaggaaccttacccgggtttgaacgtagtctgaccggagtggaaacactccttctagcaatagcagattacgaggtgctgcatggttgtcgtcagctcgtgccgtgaggtgtcggcttaagtgccataacgagcgcaacccttatcactagttactaacaggtgaagctgaggactctggtgagactgccagcgtaagctgtgaggaaggtggggatgacgtcaaatcagcacggcccttacatccggggcgacacacgtgttacaatggcatggacaaagggcagctacctggcgacaggatgctaatctccaaaccatgtctcagttcggatcggagtctgcaactcgactccgtgaagctggattcgctagtaatcgcgcatcagccatggcgcggtgaatacgttcccgggccttgtacacaccgcccgtcaagccatgggagccgggggtacctgaagtccgtaaccgcaaggacggcctagggtaaaactggtgactggggctaagtcgtaacaaggtagccgtaccggaaggtgcggctggaacacctcctttct

SEQ ID NO: 286 - DNA, 1524 bp, Artificial Sequence
  Parabacteroides_sp_D13
acaacgaagagtttgatcctggctcaggatgaacgctagcgacaggcttaacacatgcaagtcgaggggcagcacaggtagcaataccgggtggcgaccggcgcacgggtgagtaacgcgtatgcaacttgcctatcagagggggataacccggcgaaagtcggactaataccgcatgaagcaggggccccgcatggggatatttgctaaagattcatcgctgatagataggcatgcgttccattaggcagttggcggggtaacggcccaccaaaccgacgatggataggggttctgagaggaaggtcccccacattggtactgagacacggaccaaactcctacgggaggcagcagtgaggaatattggtcaatggccgagaggctgaaccagccaagtcgcgtgagggatgaaggttctatggatcgtaaacctcttttataagggaataaagtgcgggacgtgtcccgttttgtatgtaccttatgaataaggatcggctaactccgtgccagcagccgcggtaatacggaggatccgagcgttatccggatttattgggtttaaagggtgcgtaggcggccttttaagtcagcggtgaaagtctgtggctcaaccatagaattgccgttgaaactggggggcttgagtatgtttgaggcaggcggaatgcgtggtgtagcggtgaaatgcatagatatcacgcagaaccccgattgcgaaggcagcctgccaagccatgactgacgctgatgcacgaaagcgtggggatcaaacaggattagataccctggtagtccacgcagtaaacgatgatcactagctgtttgcgatacactgtaagcggcacagcgaaagcgttaagtgatccacctggggagtacgccggcaacggtgaaactcaaaggaattgacgggggcccgcacaagcggaggaacatgtggtttaattcgatgatacgcgaggaaccttacccgggtttgaacgcattcggaccgaggtggaaacaccttttctagcaatagccgtttgcgaggtgctgcatggttgtcgtcagctcgtgccgtgaggtgtcggcttaagtgccataacgagcgcaacccttgccactagttactaacaggtgatgctgaggactctggtgggactgccagcgtaagctgcgaggaaggcggggatgacgtcaaatcagcacggcccttacatccggggcgacacacgtgttacaatggcgtggacaaagggaggccacctggcgacagggagcgaatccccaaaccacgtctcagttcggatcggagtctgcaacccgactccgtgaagctggattcgctagtaatcgcgcatcagccatggcgcggtgaatacgttcccgggccttgtacacaccgcccgtcaagccatgggagccgggggtacctgaagtccgtaaccgcgaggatcggcctagggtaaaactggtgactggggctaagtcgtaacaaggtagccgtaccggaaggtgcggctggaacacctcctt

SEQ ID NO: 287 - DNA, 1481 bp, Artificial Sequence
  Parabacteroides_sp_NS31_3
agagtttgatcctggctcaggatgaacgctagcgacaggcttaacacatgcaagtcgaggggcagcatagaagtagcaatactttggtggcgaccggcgcacgggtgagtaacgcgtatgcaacctacctatcagaggggaataacccggcgaaagtcggactaataccgcataaaacaggggcaccgcatggtgatatttgttaaagaaattcgctgatagatgggcatgcgttccattaggtagttggtgaggtaacggctcaccaagccgacgatggataggggaactgagaggttggtcccccacactggtactgagacacggaccagactcctacgggaggcagcagtgaggaatattggtcaatgggcgggagcctgaaccagccaagtcgcgtgaaggaagaaggatctatggttcgtaaacttcttttgcaggggaataaagtgcgggacgtgtcctgttttgtatgtaccctgagaataaggatcggctaactccgtgccagcagccgcggtaatacggaggatccgagcgttatccggatttattgggtttaaagggtgcgtaggtggtttgataagtcagcggtgaaagtttgcagcttaactgtaaaaatgccgttgaaactgtcggacttgagtgtaaatgaggtaggcggaatgcgtggtgtagcggtgaaatgcatagatatcacgcagaactccgattgcgaaggcagcttactaagctacaactgacactgaagcacgaaagcgtggggatcaaacaggattagataccctggtagtccacgcagtaaacgatgattactagctgtttgcgatacacagtaagcggcacagcgaaagcgttaagtaatccacctggggagtacgccggcaacggtgaaactcaaaggaattgacgggggcccgcacaagcggaggaacatgtggtttaattcgatgatacgcgaggaaccttacccgggtttgaacgtagggagacaggggtggaaacatccttttcagcaatgactgcctacgaggtgctgcatggttgtcgtcagctcgtgccgtgaggtgtcggcttaagtgccataacgagcgcaacccttatttccagttactaacaggtgatgctgaggactctggagagactgccagcgtaagctgtgaggaaggtggggatgacgtcaaatcagcacggcccttacatccggggcgacacacgtgttacaatggtaaggacaaagggcagctaccgggcgaccggatgcgaatctctaaaccttatctcagttcggatcggagtctgcaactcgactccgtgaagctggattcgctagtaatcgcgcatcagccatggcgcggtgaatacgttcccgggccttgtacacaccgcccgtcaagccatgggagccgggggtacctgaagttcgtaaccgtaaggatcgacctagggtaaaactggtgactggggctaagtcgtaacaa

SEQ ID NO: 288 - DNA, 1419 bp, Artificial Sequence
  Peptostreptococcus_anaerobius
agcggcggacgggtgagtaacgcgtgggtaacctgccctatacacatggataacatactgaaaagtttactaatacatgataatatatatttacggcatcgtagatatatcaaagtgttagcggtataggatggacccgcgtctgattagctagttggtgagataactgcccaccaaggcgacgatcagtagccgacctgagagggtgatcggccacattggaactgagacacggtccaaactcctacgggaggcagcagtggggaatattgcacaatgggcgcaagcctgatgcagcaacgccgcgtgaacgatgaaggtcttcggatcgtaaagttctgttgcaggggaagataatgacggtaccctgtgaggaagccccggctaactacgtgccagcagccgcggtaatacgtagggggctagcgttatccggatttactgggcgtaaagggtgcgtaggtggtctttcaagtcggtggttaaaggctacggctcaaccgtagttagcctccgaaactggaagacttgagtgcaggagaggaaagtggaattcccagtgtagcggtgaaatgcgtagatattgggaggaacaccagtagcgaaggcggctttctggactgcaactgacactgaggcacgaaagcgtgggtagcaaacaggattagataccctggtagtccacgctgtaaacgatgagtactaggtgtcgggggttacccccctcggtgccgcagctaacgcattaagtactccgcctggggagtacgcacgcaagtgtgaaactcaaaggaattgacggggacccgcacaagtagcggagcatgtggtttaattcgaagcaacgcgaagaaccttacctaagcttgacatcccttagaccggtgtttaatcacaccttcccttcggggctgaggtgacaggtggtgcatggttgtcgtcagctcgtgtcgtgagatgttgggttaagtcccgcaacgagcgcaacccttgtctttagttgccagcattcagttgggcactctagagagactgccagggataacctggaggaaggtggggatgacgtcaaatcatcatgccccttatgcttagggctacacacgtgctacaatgggtggtacagagggttgccaaaccgtgaggtggagctaatcccttaaagccattctcagttcggattgtaggctgaaactcgcctacatgaagctggagttactagtaatcgcagatcagaatgctgcggtgaatgcgttcccgggtcttgtacacaccgcccgtcacaccatgggagtcggaaacacccgaagccgattatccaaccgcaaggaggaagtcgtcgaaggtggcgtcgataactggggtgaagtcgtaacaaggtagccgtatcggaaggtgcggctggatcacctcctttct

SEQ ID NO: 289 - DNA, 1473 bp, Artificial Sequence
  Peptostreptococcus_anaerobius
  misc_feature (64)..(64): n is a, c, g, or t
gatgaacgctggcggcgtgcctaacacatgcaagtcgagcgcgtctgatttgatgcttgcattnatgaaagatgagcggcggacgggtgagtaacgcgtgggtaacctgccctatacacatggataacatactgaaaagtttactaatacatgataatatatatttacggcatcgtagatatatcaaagtgttagcggtataggatggacccgcgtctgattagctagttggtgagataactgcccaccaaggcgacgatcagtagccgacctgagagggtgatcggccacattggaactgagacacggtccaaactcctacgggaggcagcagtggggaatattgcacaatgggcgcaagcctgatgcagcaacgccgcgtgaacgatgaaggtcttcggatcgtaaagttctgttgcaggggaagataatgacggtaccctgtgaggaagccccggctaactacgtgccagcagccgcggtaatacgtagggggctagcgttatccggatttactgggcgtaaagggtgcgtaggtggtctttcaagtcggtggttaaaggctacggctcaaccgtagttagcctccgaaactggaagacttgagtgcaggagaggaaagtggaattcccagtgtagcggtgaaatgcgtagatattgggaggaacaccagtagcgaaggcggctttctggactgcaactgacactgaggcacgaaagcgtgggtagcaaacaggattagataccctggtagtccacgctgtaaacgatgagtactaggtgtcgggggttacccccctcggtgccgcagctaacgcattaagtactccgcctggggagtacgcacgcaagtgtgaaactcaaaggaattgacggggacccgcacaagtagcggagcatgtggtttaattcgaagcaacgcgaagaaccttacctaagcttgacatcccttagaccggtgtttaatcacaccttcccttcggggctgaggtgacaggtggtgcatggttgtcgtcagctcgtgtcgtgagatgttgggttaagtcccgcaacgagcgcaacccttgtctttagttgccagcattcagttgggcactctagagagactgccagggataacctggaggaaggtggggatgacgtcaaatcatcatgccccttatgcttagggctacacacgtgctacaatgggtggtacagagggttgccaaaccgtgaggtggagctaatcccttaaagccattctcagttcggattgtaggctgaaactcgcctacatgaagctggagttactagtaatcgcagatcagaatgctgcggtgaatgcgttcccgggtcttgtacacaccgcccgtcacaccatgggagtcggaaacacccgaagccgattatccaaccgcaaggaggaagtcgtcgaaggtggcgtcgataactggggtgaagtcgtaacaaggtagccgtatcggaaggtgc

SEQ ID NO: 290 - DNA, 1432 bp, Artificial Sequence
  Peptostreptococcus_stomatis
ctgagcaaaaccaagcggcggacgggtgagtaacgcgtgggtaacctgccctatacacatggataacatactgaaaagtttactaatacatgataatatatatttgcggcatcgcagatatatcaaagtgttagcggtataggatggacccgcgtctgattagctagttggtgagataactgcccaccaaggcgacgatcagtagccgacctgagagggtgatcggccacattggaactgagacacggtccaaactcctacgggaggcagcagtggggaatattgcacaatgggcgaaagcctgatgcagcaacgccgcgtgaacgatgaaggtcttcggatcgtaaagttctgttgcaggggaagataatgacggtaccctgtgaggaagccccggctaactacgtgccagcagccgcggtaatacgtagggggctagcgttatccggatttactgggcgtaaagggtgcgtaggtggtccttcaagtcggtggttaaaggctacggctcaaccgtagtaagccgccgaaactggaggacttgagtgcaggagaggaaagtggaattcccagtgtagcggtgaaatgcgtagatattgggaggaacaccagtagcgaaggcggctttctggactgcaactgacactgaggcacgaaagcgtgggtagcaaacaggattagataccctggtagtccacgctgtaaacgatgagtactaggtgtcgggggttacccccctcggtgccgcagctaacgcattaagtactccgcctggggagtacgcacgcaagtgtgaaactcaaaggaattgacggggacccgcacaagtagcggagcatgtggtttaattcgaagcaacgcgaagaaccttacctaagcttgacatccctcggacaggtgtttaatcacacccttccttcgggactgaggtgacaggtggtgcatggttgtcgtcagctcgtgtcgtgagatgttgggttaagtcccgcaacgagcgcaacccttgtctttagttgccagcattcagttgggcactctagagagactgccagggataacctggaggaaggtggggatgacgtcaaatcatcatgccccttatgcttagggctacacacgtgctacaatgggtggtacagagggttgccaaaccgtgaggtggagccaatcccttaaagccattctcagttcggattgtaggctgaaactcgcctacatgaagctggagttactagtaatcgcagatcagaatgctgcggtgaatgcgttcccgggtcttgtacacaccgcccgtcacaccacgggagtcggaaacacccgaagccgattatccaaccgcaaggaggaagtcgtcgaaggtggcgtcgataactggggtgaagtcgtaacaaggtagccgtatcggaaggtgcggctggatcacctcctttct

SEQ ID NO: 291 - DNA, 1296 bp, Artificial Sequence
  Porphyromonadaceae_bacterium_NML_060648
caggcttaacacatgcaagtcgagggaccggcgcacgggtgagtaacgcgtatgcaacctacctatcagaggggaataacccggcgaaagtcggactaataccgcataaataaagtcgctgatagatgggcatgcgttccattaggtagttggtgaggtaacggctcaccaagccgacgatggataggggaactgagaggttggtcccccacactggtactgagacacggaccagactcctacgggaggcagcagtgaggaatattggtcaatgggcgggagcctgaaccagccaagtcgcgtgaaggaagaaggattatggttcgtaaacttcttttgcaggggaatatgtatgtaccctgagaataaggatcggctaactccgtgccagcagccgcggtaatacggaggatccgagcgttatccggatttattgggtttaaagggtgcgtaggtggtttgataagtcagcggtgaaagtttgcagcttaactgtaaaaatgccgttgaaactgtcggacttgagtgtaaatgaggtaggcggaatgcgtggtgtagcggtgaaatgcatagatatcacgcagaactccgattgcgaaggcagcttactaagctaactgacactgaagcacgaaagcgtggggatcaaacaggattagataccctggtagtccacgcagtaaacgatgattactagctgtttgcgagtaagcggcacagcgaaagcgttaagtaatccacctggggagtacgccggcaacggtgaaactcaaaggaattgacgggggcccgcacaagcggaggaacatgtggtttaattcgatgatacgcgaggaaccttacccgggtttgaacgtacgaggtgctgcatggttgtcgtcagctcgtgccgtgaggtgtcggcttaagtgccataacgagcgcaacccttatttycagttactaacagctgaggactctggagagactgccagcgtaagctggaggaaggtggggatgacgtcaaatcagcacggcccttacatccggggcgacacacgtgttacaatggtaagcaaagggcagctaccgggcgaccggatgcgaatctctcttatctcagttcggacggagtctgcaactcgactccggaagctggattcgctagtaatcgcgcatcagccatggcgcggtgaatacgttcccgggccttgtacacaccgcccgtcaagccatgggagccgggggtacctgaagttcgtatcgacctagggtaaaactggtgactggggctaagtcgtaacaaggtagccgtac

SEQ ID NO: 292 - DNA, 1483 bp, Artificial Sequence
  Pseudoflavonifractor_capillosus
gatgaacgctggcggcgtgcttaacacatgcaagtcgaacggagagctcatgacagaggattcgtccaatggattgggtttcttagtggcggacgggtgagtaacgcgtgaggaacctgcctcggagtggggaataacagtccgaaaggactgctaataccgcataatgcagctgagtcgcatgacactggctgccaaagatttatcgctctgagatggcctcgcgtctgattagctagttggcggggtaacggcccaccaaggcgacgatcagtagccggactgagaggttggccggccacattgggactgagacacggcccagactcctacgggaggcagcagtggggaatattgggcaatgggcgcaagcctgacccagcaacgccgcgtgaaggatgaaggctttcgggttgtaaacttcttttatcagggacgaaataaatgacggtacctgatgaataagccacggctaactacgtgccagcagccgcggtaatacgtaggtggcaagcgttatccggatttactgggtgtaaagggcgtgtaggcgggactgcaagtcaggtgtgaaaaccacgggctcaacctgtggcctgcatttgaaactgtagttcttgagtgctggagaggcaatcggaattccgtgtgtagcggtgaaatgcgtagatatacggaggaacaccagtggcgaaggcggattgctggacagtaactgacgctgaggcgcgaaagcgtggggagcaaacaggattagataccctggtagtccacgccgtaaacgatggatactaggtgtggggggactgaccccctccgttgccgcagttaacacaataagtatcccacctggggagtacgatcgcaaggttgaaactcaaaggaattgacgggggcccgcacaagcggtggagtatgtggtttaattcgaagcaacgcgaagaaccttaccagggcttgacatccgactaacgaagcagagatgcattaggtgcccttcggggaaagtcgagacaggtggtgcatggttgtcgtcagctcgtgtcgtgagatgttgggttaagtcccgcaacgagcgcaacccttattgttagttgctacgcaagagcactctagcgagactgccgttgacaaaacggaggaaggtggggacgacgtcaaatcatcatgccccttatgtcctgggccacacacgtactacaatggtggttaacagagggaagcaatgccgcgaggtggagcaaatccctaaaagccatcccagttcggattgcaggctgaaacccgcctgtatgaagttggaatcgctagtaatcgcggatcagcatgccgcggtgaatacgttcccgggccttgtacacaccgcccgtcacaccatgagagtcgggaacacccgaagtccgtagcctaaccgcaaggagggcgcggccgaaggtgggttcgataattggggtgaagtcgtaacaaggtagccgtatcggaa

SEQ ID NO: 293 - DNA, 1480 bp, Artificial Sequence
  Pseudoramibacter_alactolyticus
taagtcaaaaagaacagtttgatcatggctcaggacgaacgctggcggtatgcttaacacatgcaagtcgaacgagaagttttttattgaccttcgggggatataagagacagacagtggcgaacgggtgagtaacgcgtgggcaacctacctatcggagcgggatagcctcgagaaatcgggagtaaaaccgcataacacagcagaatcgcatgactttgctgtcaaaactccggtgccgatagatgggcccgcgtctgattagctagttggtaaggtaagggcttaccaaggcaacgatcagtagccggtctgagagggcgaacggccacactggaactgagacacggtccagactcctacgggaggcagcagtggggaatattgcgcaatgggggcaaccctgacgcagcaataccgcgtgagtgaagaaggttttcggatcgtaaagctctgttattggggaagaagcagtgacggtacccaatgaggaagtcccggctaactacgtgccagcagccgcggtaatacgtaggggacgagcgttgtccggaatcactgggcgtaaagggcgcgtaggcggttttataagtcagatgtgaaaggtaccggctcaaccggtgacgtgcatttgaaactgtaagacttgagtactgaagaggcaagcggaattcctagtgtagcggtgaaatgcgtagatattaggaagaacaccggtggcgaaggcggcttgctgggcagatactgacgctgaggtgcgaaagcgtggggagcgaacaggattagataccctggtagtccacgccgtaaacgatgaatactaggtgttggcgaataagtcagtgccggagttaacacaataagtattccgcctggggagtacgaccgcaaggttgaaactcaaaggaattgacggggacccgcacaagcagcggagcatgtggtttaattcgaagcaacgcgaagaaccttaccaggccttgacatcctctgagcgcaatagagatattgctttcccttcggagacagagagacaggtggtgcatggttgtcgtcagctcgtgtcgtgagatgttgggttaagtcccgcaacgagcgcaacccctgtcattagttgccatcattgagttgggcactctaatgagactgccgtagacaatacggaggaaggtggggacgacgtcaaatcatcatgccccttatggcctgggctacacacgtgctacaatggtctgaacaaagggaagcgaaggagcgattcggagcgaatctcataaaacagatcccagttcggattgcaggctgcaactcgcctgcatgaagatggagttgctagtaatcgcggatcagaatgtcgcggtgaatgcgttcccgggtcttgtacacaccgcccgtcacaccacgagagtcggtaacacccgaagccagtgagacaaccggaaggagtcagctgtcgaaggtgggatcggtaattggggtg

SEQ ID NO: 294 - DNA, 1297 bp, Artificial Sequence
  Roseburia_faecis
gatgaacgctggcggcgtgcttaacacatgcaagtcgaacgagtggcggacgggtgagtaacgcgtgggtaacctgcctcatacagggggataacagttggaaacgactgctaataccgcataagaaaaagtggtatgagatggacccgcgtctgattagccagttggcagggtaacggcctaccaaagcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagatgacggtacctgactaagaagcaccggctaaatacgtgccagcagccgcggtaatacgtatggtgcaagcgttatccggatttactgggtgtaaagggagcgcaggcggtgcggcaagtctgatgtgaaagcccggggctcaaccccggtactgcattggaaactgtcgtactagagtgtcggaggggtaagtggaattcctagtgtagcggtgaaatgcgtagatattaggaggaacaccagtggcgaaggcggcttactggacgaactgacgctgaggctcgaaagcgtggggagcaaacaggattagataccctggtagtccacgccgtaaacgatgaatactaggtgtcggggcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcgacaggtggtgcatggttgtcgtcagctcgtgtcgtgagatgttgggttaagtcccgcaacgagcgcaacccctgtccttagtagccagcggccgggcactctagggagactgccagggataacctggaggaaggcggggatgacgtcaaatcatcatgccccttatgacttgggctacacacgtgctacaatggcgtacaaagggaagcggagccgtgaggccgagcaaatctcaaaacgtctcagttcggatgtagtctgcaacccgactacagaagctggaatcgctagtaatcgcagatcagaatgctgcggtgaatacgttcccgggtcttgtacacaccgcccgtcacaccatgggagttggaaatgcccgaagtcagtacccagggagctgccgaaggcaggttcgataactggggtg

SEQ ID NO: 295 - DNA, 1482 bp, Artificial Sequence
  Roseburia_intestinalis
ttgatcctggctcaggatgaacgctggcggcgtgcttaacacatgcaagtcgaacgaagcactttatttgatttcttcggaatgaagattttgtgactgagtggcggacgggtgagtaacgcgtgggtaacctgcctcatacagggggataacagttggaaacgactgctaataccgcataagcgcacagggtcgcatgacctggtgtgaaaaactccggtggtatgagatggacccgcgtctgattagccagttggtggggtaacggcctaccaaagcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaagaaatgacggtacctgactaagaagcaccggctaaatacgtgccagcagccgcggtaatacgtatggtgcaagcgttatccggatttactgggtgtaaagggagcgcaggcggtacggcaagtctgatgtgaaagcccggggctcaaccccggtactgcattggaaactgtcggactagagtgtcggaggggtaagtggaattcctagtgtagcggtgaaatgcgtagatattaggaggaacaccagtggcgaaggcggcttactggacgattactgacgctgaggctcgaaagcgtggggagcaaacaggattagataccctggtagtccacgccgtaaacgatgaatactaggtgtcggggagcattgctcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccgatgacagaacatgtaatgtgttttctcttcggagcatcggtgacaggtggtgcatggttgtcgtcagctcgtgtcgtgagatgttgggttaagtcccgcaacgagcgcaacccctattcttagtagccagcgggtmagccgggcactctagggagactgccagggataacctggaggaaggtggggatgacgtcaaatcatcatgccccttatgacttgggctacacacgtgctacaatggcgtaaacaaagggaagcgagcctgcgagggggagcaaatctcaaaaataacgtctcagttcggactgcagtctgcaactcgactgcacgaagctggaatcgctagtaatcgcgaatcagaatgtcgcggtgaatacgttcccgggtcttgtacacaccgcccgtcacaccatgggagttggtaatgcccgaagtcagtgacccaaccgcaaggagggagctgccgaagcaggatcgataactggggtgaagtcgtaacaag

SEQ ID NO: 296 - DNA, 1521 bp, Artificial Sequence
  Roseburia_intestinalis
agagtttgatcctggctcaggatgaacgctggcggcgtgcttaacacatgcaagtcgaacgaagcactttatttgatttcttcggaatgaagattttgtgactgagtggcggacgggtgagtaacgcgtgggtaacctgcctcatacagggggataacagttggaaacgactgctaataccgcataagcgcacagggtcgcatgacctggtgtgaaaaactccggtggtatgagatggacccgcgtctgattagccagttggtggggtaacggcctaccaaagcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaagaaatgacggtacctgactaagaagcaccggctaaatacgtgccagcagccgcggtaatacgtatggtgcaagcgttatccggatttactgggtgtaaagggagcgcaggcggtacggcaagtctgatgtgaaagcccggggctcaaccccggtactgcattggaaactgtcggactagagtgtcggaggggtaagtggaattcctagtgtagcggtgaaatgcgtagatattaggaggaacaccagtggcgaaggcggcttactggacgattactgacgctgaggctcgaaagcgtggggagcaaacaggattagataccctggtagtccacgccgtaaacgatgaatactaggtgtcggggagcattgctcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccgatgacagaacatgtaatgtgttttctcttcggagcatcggtgacaggtggtgcatggttgtcgtcagctcgtgtcgtgagatgttgggttaagtcccgcaacgagcgcaacccctattcttagtagccagcgggtaagccgggcactctagggagactgccagggataacctggaggaaggtggggatgacgtcaaatcatcatgccccttatgacttgggctacacacgtgctacaatggcgtaaacaaagggaagcgagcctgcgagggggagcaaatctcaaaaataacgtctcagttcggactgcagtctgcaactcgactgcacgaagctggaatcgctagtaatcgcgaatcagaatgtcgcggtgaatacgttcccgggtcttgtacacaccgcccgtcacaccatgggagttggtaatgcccgaagtcagtgacccaaccgcaaggagggagctgccgaaggcaggatcgataactggggtgaagtcgtaacaaggtagccgtatcggaaggtgcggctggatcacct

SEQ ID NO: 297 - DNA, 1454 bp, Artificial Sequence
  Roseburia_inulinivorans
ttgatcctggctcaggatgaacgctggcggcgtgcttaacacatgcaagtcgaacgaagcacttttacagatttcttcggaatgaagttttagtgactgagtggcggacgggtgagtaacgcgtgggtaacctgcctcacacagggggataacagttggaaacggctgctaataccgcataagcgcacagtaccgcatggtacagtgtgaaaaactccggtggtgtgagatggacccgcgtctgattagctagttggcagggcaacggcctaccaaggcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaagaaatgacggtacctgactaagaagcaccggctaaatacgtgccagcagccgcggtaatacgtatggtgcaagcgttatccggatttactgggtgtaaagggagcgcaggcggaaggctaagtctgatgtgaaagcccggggctcaaccccggtactgcattggaaactggtcatctagagtgtcggaggggtaagtggaattcctagtgtagcggtgaaatgcgtagatattaggaggaacaccagtggcgaaggcggcttactggacgataactgacgctgaggctcgaaagcgtggggagcaaacaggattagataccctggtagtccacgccgtaaacgatgaatactaggtgtcggaaagcacagcttttcggtgccgccgcaaacgcattaagtattccacctggggagtacgttcgcaagaatgaaactcaaaggaattgacggggacccgcacaagcggtggagcatgtggtttaattcgaagcaacgcgaagaaccttaccaagtcttgacatccttctgaccggacagtaatgtgtcctttccttcgggacagaagtgacaggtggtgcatggttgtcgtcagctcgtgtcgtgagatgttgggttaagtcccgcaacgagcgcaacccttatccccagtagccagcggttcggacgggcactctgaggagactgccagggataacctggaggaaggtggggatgacgtcaaatcatcatgccccttatgacttgggctacacacgtgctacaatggcgtaaacaaagggaagcgagaccgtgaggtggagcaaatcccaaaaataacgtctcagttcggactgtagtctgcaacccgactacacgaagctggaatcgctagtaatcgcagatcagaatgctgcggtgaatacgttcccgggtcttgtacacaccgcccgtcacaccatgggagttggaaatgcccgaagtcagtgacccaaccgcaaggagggagctgcgaaggcaggt

SEQ ID NO: 298 - DNA, 1526 bp, Artificial Sequence
  Ruminococcaceae_bacterium_D16
agagtttgatcctggctcaggatgaacgctggcggcgtgcttaacacatgcaagtcgaacggagtgcctttgaaagaggattcgtccaattgataaggttacttagtggcggacgggtgagtaacgcgtgaggaacctgccttggagtggggaataacacagtgaaaattgtgctaataccgcataatgcagttgggccgcatggctctgactgccaaagatttatcgctctgagatggcctcgcgtctgattagctagttggtggggtaacggcccaccaaggcgacgatcagtagccggactgagaggttggccggccacattgggactgagacacggcccagactcctacgggaggcagcagtggggaatattgggcaatgggcgcaagcctgacccagcaacgccgcgtgaaggaagaaggctttcgggttgtaaacttcttttcttagggacgaagcaagtgacggtacctaaggaataagccacggctaactacgtgccagcagccgcggtaatacgtaggtggcaagcgttatccggatttactgggtgtaaagggcgtgtaggcgggattgcaagtcagatgtgaaaaccacgggctcaacctgtggcctgcatttgaaactgtagttcttgagtactggagaggcagacggaattcctagtgtagcggtgaaatgcgtagatattaggaggaacaccagtggcgaaggcggtctgctggacagcaactgacgctgaggcgcgaaagcgtggggagcaaacaggattagataccctggtagtccacgctgtaaacgatggatactaggtgtggggggtctgaccccttccgtgccgcagttaacacaataagtatcccacctggggagtacgatcgcaaggttgaaactcaaaggaattgacgggggcccgcacaagcggtggagtatgtggtttaattcgaagcaacgcgaagaaccttaccagggcttgacatcccgaggcccggtctagagatagacctttctcttcggagacctcggtgacaggtggtgcatggttgtcgtcagctcgtgtcgtgagatgttgggttaagtcccgcaacgagcgcaacccctattgttagttgctacgcaagagcactctagcgagactgccgttgacaaaacggaggaaggtggggacgacgtcaaatcatcatgccccttatgtcctgggccacacacgtactacaatggtggttaacagagggaggcaataccgcgaggtggagcaaacccctaaaagccatcccagttcggattgcaggctgcaacccgcctgcatgaagttggaatcgctagtaatcgcggatcagcatgccgcggtgaatacgttcccgggccttgtacacaccgcccgtcacaccatgagagtcgggaacacccgaagtccgtagcctaaccgcaaggggggcgcggccgaaggtgggttcgataattggggtgaagtcgtaacaaggtagccgtatcggaaggtgcggctggatcacctcctttct

SEQ ID NO: 299 - DNA, 1342 bp, Artificial Sequence
  Ruminococcus_bromii
  misc_feature (503)..(503): n is a, c, g, or t
  misc_feature (792)..(793): n is a, c, g, or t
  misc_feature (1025)..(1025): n is a, c, g, or t
  misc_feature (1245)..(1245): n is a, c, g, or t
tttgatttagtttagtggcggacgggtgagtaacgcgtgagtaacctgccttcaagagggggataacattctgaaaagaatgctaataccgcatgacatatcggaaccacatggttctgatatcaaagattttatcgcttgaagatggactcgcgtccgattagttagttggtgaggtaacggctcaccaagaccgcgatcggtagccggactgagaggttgaacggccacattgggactgagacacggcccagactcctacgggaggcagcagtgggggatattgcgcaatgggggcaaccctgacgcaccaacgccgcgtgaaggatgaaggttttcggattgtaaacttcttttattaaggacgaaaaatgacggtacttaatgaataagctccggctaactacgtgccagcagccgcggtaatacgtagggagcaagcgttgtccggatttactgggtgtaaagggtgcgtaggcggctttgcaagtcagatgtgaaantctatgggctcaacccataaactgcatttgaaactgtagagcttgagtgaagtagaggcaggcggaattccccgtgtagcggtgaaatgcgtagagatggggaggaacaccagtggcgaaggcggcctgctgggctttaactgacgctgaggcacgaaagcgtgggtagcaaacaggattagataccctggtagtccacgctgtaaacgatgattactaggtgtggagggtctgaccccttccgtgccggagttaacacaataagtaatccacctggggagtacggmcnnaargttgaaactcaaaggaattgacgggggcccgcacaagcagtggagtatgtggtttaattcgaagcaacgcgaagaaccttaccaggtcttgacatccaactaacgaagtagagatacattaggtgcccttcggggaaagttgagacaggtggtgcatggttgtcgtcagctcgtgtcgtgagatgttggkttaagtcccgcaacgagcgcaacccttgctattagttgntacgcaagagcactctaataggactgccgttgacaaaacggaggaaggtggggacgacgtcaaatcatcatgccccttatgacctgggctacacacgtactacaatggatgttaacagagggaagcaagacagtgatgtggagcaaacccctaaaaacattctcagttcagattgcaggctgcaacccgcctgcatgaagatggaattgctagtaatcgnggatcagaatgmcgcggtgaatacgttcccgggccttgtacacaccgcccgtcacaccatgggagccggtaatacccgaagtcagtagtccaacctc

SEQ ID NO: 300 - DNA, 1452 bp, Artificial Sequence
  Ruminococcus_bromii
gacgaacgctggcggcgtgcctaacacatgcaagtcgaacggaactgttttgaaagatttcttcggaatgaatttgatttagtttagtggcggacgggtgagtaacgcgtgagtaacctgccttcaagagggggataacattctgaaaagaatgctaataccgcatgayatatcggaaccacatggttytgatatcaaagattttatcgcttgaagatggactcgcgtccgattagttagttggtgaggtaacggctcaccaagaccgcgatcggtagccggactgagaggttgaacggccacattgggactgagacacggcccagactcctacgggaggcagcagtgggggatattgcgcaatgggggcaaccctgacgcagcaacgccgcgtgaaggatgaaggttttcggattgtaaacttcttttattaaggacgaaacttgacggtacttaatgaataagctccggctaactacgtgccagcagccgcggtaatacgtagggagcaagcgttgtccggatttactgggtgtaaagggtgcgtaggcggctttgcaagtcagatgtgaaatctatgggctcaacccataaactgcatttgaaactgtagagcttgagtgaagtagaggcaggcggaattccccgtgtagcggtgaaatgcgtagagatggggaggaacaccagtggcgaaggcggcctgctgggctttaactgacgctgaggcacgaaagcgtgggtagcaaacaggattagataccctggtagtccacgctgtaaacgatgattactaggtgtggggggtctgaccccttccgtgccggagttaacacaataagtaatccacctggggagtacggccgcaaggttgaaactcaaaggaattgacgggggcccgcacaagcagtggagtatgtggtttaattcgaagcaacgcgaagaaccttaccaggtcttgacatccaactaacgaagtagagatacattaggtgcccttcggggaaagttgagacaggtggtgcatggttgtcgtcagctcgtgtcgtgagatgttgggttaagtcccgcaacgagcgcaacccttgctattagttgctacgcaagagcactctaataggactgccgttgacaaaacggaggaaggtggggacgacgtcaaatcatcatgccccttatgacctgggctacacacgtactacaatggatgttaacagagggaagcaagacagcgatgtggagcaaacccctaaaaacattctcagttcagattgcaggctgcaacccgcctgcatgaagatggaattgctagtaatcgcggatcagcatgccgcggtgaatacgttcccgggccttgtacacaccgcccgtcacaccatgggagccggtaatacccgaagtcagtagtccaacctcgtgaggacgctgccgaaggtaggattggcgactggggtg

SEQ ID NO: 301 - DNA, 1446 bp, Artificial Sequence
  Ruminococcus_hansenii
  misc_feature (25)..(25): n is a, c, g, or t
  misc_feature (105)..(105): n is a, c, g, or t
  misc_feature (182)..(182): n is a, c, g, or t
  misc_feature (244)..(244): n is a, c, g, or t
  misc_feature (280)..(280): n is a, c, g, or t
  misc_feature (343)..(344): n is a, c, g, or t
  misc_feature (395)..(395): n is a, c, g, or t
  misc_feature (510)..(510): n is a, c, g, or t
  misc_feature (529)..(529): n is a, c, g, or t
  misc_feature (600)..(600): n is a, c, g, or t
  misc_feature (602)..(602): n is a, c, g, or t
  misc_feature (612)..(612): n is a, c, g, or t
  misc_feature (645)..(646): n is a, c, g, or t
  misc_feature (676)..(676): n is a, c, g, or t
  misc_feature (911)..(911): n is a, c, g, or t
  misc_feature (915)..(915): n is a, c, g, or t
  misc_feature (949)..(950): n is a, c, g, or t
  misc_feature (1114)..(1114): n is a, c, g, or t
  misc_feature (1126)..(1127): n is a, c, g, or t
  misc_feature (1177)..(1178): n is a, c, g, or t
  misc_feature (1192)..(1194): n is a, c, g, or t
  misc_feature (1367)..(1367): n is a, c, g, or t
  misc_feature (1386)..(1387): n is a, c, g, or t
  misc_feature (1424)..(1424): n is a, c, g, or t
gagagtttgatcctggctcaggatnaacgctggcggcgtgcttaacacatgcaagtcgagcgaagcacttatcattgactcttcggaagatttgatatttgactnagcggcggacgggtgagtaacgcgtgggtaacctgcctcatacaggggaataacagttagaaatggctgctaatgcncataagcgcacagggaccgcatggtctggtgtgaaaaactgaggtggtatgagatggacccncgtctgattaggtagttggtggggtaacggcctacnaagccgacgatcagtagccggcctgagagggtgaacggccacattgggactgagacacggccnngactcctacgggaggcagcagtggggaatattgcacaatgggggaaacccngatgcagcgacgccgcgtgaaggaagaagtatctcggtatgtaaacttctatcagcagggaagaaaatgacggtacctgactaagaagccccggctaactacgtgccagcagccncggtaatacgtagggggcnagcgttatccggatttactgggtgtaaagggagcgtagacggaagagcaagtctgatgtgaaaggctgggncntaaccccagnactgcattggaaactgtttttctagagtgccgnngaggtaagcggaattcctagtgtagcggtnaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcggggtgcaaagcagttcggtgccgcagcaaacgcaataagtattccacctggggagtacgttcgcaagaatgaaactcaaaggaattgacgggnaccngcacaagcggtggagcatgtggtttaattcgaannaacgcgaagaaccttaccaagtcttgacatctgcctgaccgttccttaaccggagctttcttcgggacaggcaagacaggtggtgcatggttgtcgtcagctcgtgtcgtgagatgttgggttaagtcccgcaacgagcgcaacccctatccttagtagccagnagtccggctggnnactctagggagactgccggggataacccggaggaaggcggggacgacgtnnaatcatcatgcccnnnatgatttgggctacacacgtgctacaatggcgtaaacaaagggaagcgaagcggtgacgcttagcaaatctcaaaaataacgtcccagttcggactgcagtctgcaactcgactgcacgaagctggaatcgctagtaatcgcgaatcagaatgtcgcggtgaatacgttcccnggtcttgtacacaccgccnntcacaccatgggagtcagtaacgcccgaagtcagtgncccaaccttatggagggagctg

SEQ ID NO: 302 - DNA, 1529 bp, Artificial Sequence
  Ruminococcus_lactaris
gagagtttgatcctggctcaggatgaacgctggcggcgtgcttaacacatgcaagtcgagcgaagcactttgctttgatttcttcgggatgaagagcttagtgactgagcggcggacgggtgagtaacgcgtgggtaacctgcctcatacagggggataacagttagaaatgactgctaataccgcataagaccacagcaccgcatggtgcaggggtaaaaactccggtggtatgagatggacccgcgtctgattagttagttggtggggtaacggcctaccaaggcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggagcagcaagtctgatgtgaaaacccggggctcaaccccgggactgcattggaaactgttgatctggagtgccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgactactaggtgtcgggtggcaaagccattcggtgccgcagccaacgcaataagtagtccacctggggagtacgttcgcaagaatgaaactcaaaggaattgacggggacccgcacaagcggtggagcatgtggtttaattcgaagcaacgcgaagaaccttacctgctcttgacatcccggtgacggcagagtaatgtctgcttttcttcggaacaccggtgacaggtggtgcatggttgtcgtcagctcgtgtcgtgagatgttgggttaagtcccgcaacgagcgcaacccctatcttcagtagccagcggtaaggccgggcactctggagagactgccagggataacctggaggaaggtggggatgacgtcaaatcatcatgccccttatgagcagggctacacacgtgctacaatggcgtaaacaaagggaagcgaacccgcgagggtgggcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggagggagctgccgaaggtgggaccgataactggggtgaagtcgtaacaaggtagccgtatcggaaggtgcggctggatcacctcctttct

SEQ ID NO: 303 - DNA, 1113 bp, Artificial Sequence
  Ruminococcus_obeum
agagtttgatcctggctcaggatgaacgctggcggcgtgcttaacacatgcaagtcgaacgggaaaccttttattgaagcttcggcagatttagctggtttctagtggcggacgggtgagtaacgcgtgggtaacctgccctatacagggggataacaaccagaaatggttgctaataccgcataagcgcacaggaccgcatggtccggtgtgaaaaactccggtggtataggatggacccgcgttggattagccagttggcagggtaacggcctaccaaagcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggattagcaagtctgatgtgaaaggcaggggctcaacccctggactgcattggaaactgccagtcttgagtgccggagaggtaagcggaattcctagtgtagcggtgaaatgcgtagatattaggaggaacaccagtggcgaaggcggcttactggacggcaactgacgttgaggctcgaaagcgtggggagcaaacaggattagataccctggtagtccacgccgtaaacgatgaatactaggtgttggggagcaaagctcttcggtgccgccgcaaacgcattaagtattccacctggggagtacgttcgcaagaatgaaactcaaaggaattgacggggacccgcacaagcggtggagcatgtggtttaattcgaagcaacgcgaagaaccttaccaagtcttgacatccctctgaccgactcttaaccgagtctttccttcgggacagaggagacaggtggtgcatggttgtcgtcagctcgtgtcgtgagatgttgggttaagtcccgcaacgagcgcaacccctatccccagtagccagc

SEQ ID NO: 304 - DNA, 1457 bp, Artificial Sequence
  Ruminococcus_obeum
  misc_feature (65)..(66): n is a, c, g, or t
  misc_feature (960)..(960): n is a, c, g, or t
ggcggcgtgcttaacacatgcaagtcgaacgggaaacctttcattgaagcttcggcagatttggnntgtttctagtggcggacgggtgagtaacgcgtgggtaacctgccttatacagggggataacaaccagaaatggttgctaataccgcataagcgcacaggaccgcatggtctggtgtgaaaaactccggtggtataagatggacccgcgttggattagctagttggcagggtaacggcctaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggactggcaagtctgatgtgaaaggcgggggctcaacccctggactgcattggaaactgttagtcttgagtgccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgattactaggtgttggggagcaaagctcttcggtgccgccgcaaacgcattaagtattccacctggggagtacgttcgcaagaatgaaactcaaaggaattgacggggacccgcacaagcggtggagcatgtggtttaattcgaagcaacgcgaagaaccttaccaagtcttgacatccctctgaccgncccttaaccggatctttccttcgggacaggggagacaggtggtgcatggttgtcgtcagctcgtgtcgtgagatgttgggttaagtcccgcaacgagcgcaacccctatccccagtagccagcagtccggctgggcactctgaggagactgccagggataacctggaggaaggcggggatgacgtcaaatcatcatgccccttatgatttgggctacacacgtgctacaatggcgtaaacaaagggaagcaagcctgcgaaggtaagcaaatcccaaaaataacgtcccagttcggactgcagtctgcaactcgactgcacgaagctggaatcgctagtaatcgcggatcagaatgccgcggtgaatacgttcccgggtcttgtacacaccgcccgtcacaccatgggagtcagtaacgcccgaagtcagtgacctaactgcaaagaaggagctgccgaaggcgggaccgatgactggggtgaagtcgtaacaaggt

SEQ ID NO: 305 - DNA, 1490 bp, Artificial Sequence
  Ruminococcus_obeum
agagtttgatcctggctcagaatgaacgctgcggcgtgtttaacacatgcaagtcgaacgggaattattttatttgaaacttcggtcgatttaattattctagtggcggacgggtgagtaacgcgtgggtaacctgccttatacagggggataccagtcagaaatggctgctaataccgcataagcgcacagagctgcatggctcagtgtgaaaaactccggtggtataagatggacccgcgttggattagctagttggtggggtaacggcccaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggtgtggcaagtctgatgtgaaaggcatgggctcaacctgtggactgcattggaaactgtcatacttgagtgccggaggggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcggggagcatggctcttcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatccgcctgaccgatccttaaccggatctttccttcgggacaggcgagacaggtggtgcatggttgtcgtcagctcgtgtcgtgagatgttgggttaagtcccgcaacgagcgcaacccctatcctcagtagccagcaagttaagttgggcactctgtggagactgccagggataacctggaggaaggcggggatgacgtcaaatcatcatgccccttatgatttgggctacacacgtgctacaatggcgtaaacaaagggaagcgagattgtgagatggagcaaatcccaaaaataacgtcccagttcggactgtagtctgcaacccgactacacgaagctggaatcgctagtaatcgcggatcagaatgccgcggtgaatacgttcccgggtcttgtacacaccgcccgtcacaccatgggagtcagtaacgcccgaagtcagtgacctaactgcaaagaaggagctgccgaaggcgggaccgatgactggggtgaagtcgtaacaaggtaacc

SEQ ID NO: 306 - DNA, 1523 bp, Artificial Sequence
  Ruminococcus_sp_5_1_39BFAA
gagagtttgatcctggctcaggatgaacgctggcggcgtgcttaacacatgcaagtcgaacgggaattactttattgacttcggtggatttgatctatttctagtggcggacgggtgagtaacgcgtgggtaacctgccttatacagggggataacagtcagaaatggctgctaataccgcataagcgcacagagctgcatggctcagtgtgaaaaactccggtggtataagatggacccgcgttggattagctgttggtggggtaacggcccaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggtgtggcaagtctgatgtgaaaggcatgggctcaacctgtggactgcattggaaactgtcatacttgagtgccggaggggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcggggagcatggctcttcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatccgcctgaccgatccttaaccggatctttccttcgggacaggcgagacaggtggtgcatggttgtcgtcagctcgtgtcgtgagatgttgggttaagtcccgcaacgagcgcaacccctatcctcagtagccagcatttaaggtgggcactctggggagactgccagggataacctggaggaaggcggggatgacgtcaaatcatcatgccccttatgatttgggctacacacgtgctacaatggcgtaaacaaagggaagcgagattgtgagatggagcaaatcccaaaaataacgtcccagttcggactgtagtctgcaacccgactacacgaagctggaatcgctagtaatcgcggatcagaatgccgcggtgaatacgttcccgggtcttgtacacaccgcccgtcacaccatgggagtcagtaacgcccgaagtcagtgacctaactgcaaagaaggagctgccgaaggcgggaccgatgactggggtgaagtcgtaacaaggtagccgtatcggaaggtgcggctggatcacctcctttct

SEQ ID NO: 307 - DNA, 1286 bp, Artificial Sequence
  Ruminococcus_sp_K_1
cctggctcaggatgaacgctggcggcgtgcttaacacatgcaagtcgaacgagtggcggacgggtgagtaacgcgtgggtaacctgccttatacagggggataacagtcagaaatggctgctaataccgcataagaaaaagtggtataagatggacccgcgttggattagcttgttggtggggtaacggcccaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatgacggtacctgactaagaagccccggctaactacgtgccagcagccgcggtaatacgtagggggcaagcgttatccggatttactgggtgtaaagggagcgtagacggtgtggcaagtctgatgtgaaaggcatgggctcaacctgtggactgcattggaaactgtcatacttgagtgccggaggggtaagcggaattcctagtgtagcggtgaaatgcgtagatattaggaggaacaccagtggcgaaggcggcttactggacggactgacgttgaggctcgaaagcgtggggagcaaacaggattagataccctggtagtccacgccgtaaacgatgaatactaggtgtcggggcttcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatcgacaggtggtgcatggttgtcgtcagctcgtgtcgtgagatgttgggttaagtcccgcaacgagcgcaacccctatcctcagtagccagcatgtgggcactctggggagactgccagggataacctggaggaaggcggggatgacgtcaaatcatcatgccccttatgatttgggctacacacgtgctacaatggcgtacaaagggaagcgagattgtgagatggagcaaatcccaaaacgtcccagttcggatgtagtctgcaacccgactacagaagctggaatcgctagtaatcgcggatcagaatgccgcggtgaatacgttcccgggtcttgtacacaccgcccgtcacaccatgggagtcagtaacgcccgaagtcagtacctaaggagctgccgaag

SEQ ID NO: 308 - DNA, 1528 bp, Artificial Sequence
  Ruminococcus_torques
gagagtttgatcctggctcaggatgaacgctggcggcgtgcctaacacatgcaagtcgagcgaagcactttgcttagattcttcggatgaagaggattgtgactgagcggcggacgggtgagtaacgcgtgggtaacctgcctcatacagggggataacagttagaaatgactgctaataccgcataagaccacagcaccgcatggtgcgggggtaaaaactccggtggtatgagatggacccgcgtctgattagctagttggtaaggtaacggcttaccaaggcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaaaatgacggtacctgactaagaagcaccggctaaatacgtgccagcagccgcggtaatacgtatggtgcaagcgttatccggatttactgggtgtaaagggagcgtagacggatgggcaagtctgatgtgaaaacccggggctcaaccccgggactgcattggaaactgttcatctagagtgctggagaggtaagtggaattcctagtgtagcggtgaaatgcgtagatattaggaggaacaccagtggcgaaggcggcttactggacagtaactgacgttgaggctcgaaagcgtggggagcaaacaggattagataccctggtagtccacgccgtaaacgatgactactaggtgtcgggtggcaaagccattcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctgctcttgacatcccgctgaccggacggtaatgcgtccttcccttcggggcagcggagacaggtggtgcatggttgtcgtcagctcgtgtcgtgagatgttgggttaagtccccgcaacgagcgcaacccctatctttagtagccagcggccaggccgggcactctagagagactgccggggataacccggaggaaggtggggatgacgtcaaatcatcatgccccttatgagcagggctacacacgtgctacaatggcgtaaacaaagggaagcgagaccgcgaggtggagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggagggagctgccgaaggcgggaccgataactggggtgaagtcgtaacaaggtagccgtatcggaaggtgcggctggatcacctcctttct

SEQ ID NO: 309 - DNA, 1527 bp, Artificial Sequence
  Ruminococcus_torques
gagagtttgatcctggctcaggatgaacgctggcggcgtgcttaacacatgcaagtcgaacgaagcaccttgatttgattcttcggatgaagatcctggtgactgagtggcggacgggtgagtaacgcgtgggtaacctgcctcatacagggggataacagttagaaatgactgctaataccgcataagaccacagcaccgcatggtgcaggggtaaaaactccggtggtatgagatggacccgcgtctgattaggtagttggtggggtaacggcctaccaagccgacgatcagtagccgacctgagagggtgaccggccacattgggactgagacacggcccaaactcctacgggaggcagcagtggggaatattgcacaatgggggaaaccctgatgcagcgacgccgcgtgagcgatgaagtatttcggtatgtaaagctctatcagcagggaagaaaatgacggtacctgactaagaagcaccggctaaatacgtgccagcagccgcggtaatacgtatggtgcaagcgttatccggatttactgggtgtaaagggagcgtagacggagtggcaagtctgatgtgaaaacccggggctcaaccccgggactgcattggaaactgtcaatctggagtaccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgactactaggtgtcgggcagcaaagctgttcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctgctcttgacatctccctgaccggcaagtaatgttgcctttccttcgggacagggatgacaggtggtgcatggttgtcgtcagctcgtgtcgtgagatgttgggttaagtcccgcaacgagcgcaacccctatctttagtagccagcggtcaggccgggcactctagagagactgccagggataacctggaggaaggtggggatgacgtcaaatcatcatgccccttatgagcagggctacacacgtgctacaatggcgtaaacaaagggaggcagaaccgcgaggtcgagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggagggagctgccgaaggtgggaccgataactggggtgaagtcgtaacaaggtagccgtatcggaaggtgcggctggatcacctcctttct

SEQ ID NO: 310 - DNA, 1506 bp, Artificial Sequence
  Sporobacter_termitidis
  misc_feature (361)..(361): n is a, c, g, or t
  misc_feature (377)..(377): n is a, c, g, or t
  misc_feature (863)..(863): n is a, c, g, or t
  misc_feature (1094)..(1094): n is a, c, g, or t
  misc_feature (1104)..(1104): n is a, c, g, or t
  misc_feature (1110)..(1110): n is a, c, g, or t
agagtttgatcctggctcaggacgaacgctggcggcgtgcctaacacatgcaagtcgaacggagacaattggttcgctgattgtcttagtggcggacgggtgagtaacgcgtgagcaatctgcccttcggagggggacaacagctggaaacggctgctaataccgcataatgtatattcaaggcatcttggatataccaaagatttatcgccgaaggatgagctcgcgtctgattagctagttggtgaggtaaaggctcaccaaggctgcgatcagtagccggactgagaggttgaacggccacattggaactgagatacgggccagactcctacgggagggagcagtggggaattttggncaatgggggaaagccntacccagcaacgccgcgtgaaggaagaaggccttcgggttgtaaacttctttgaccagggacgaaacaaatgacggtacctggaaaacaagccacggctaactacgtgccagcagccgcggtattacgtaggtggcaagcgttgtccggatttactgggtgtaaagggcgcgtaggcgggagtacaagtcagatgtgaaatctgggggcttaaccctcaaactgcatttgaaactgtatttcttgagtatcggagaggcaggcggaattcctagtgtagcggtgaaatgcgttgatattaggaggaacaccagtggcgaaggcggcctgctggacgacaactgactctgaggcgcgaaagcgtggggagcaaacaggattagataccctggtagtccacgctgtaaacgatgaatactaggtgtggggggactgaccccctccgtgccggagttaacacaataagtattccacctggggagtacgnccgcaaggttgaaactcaaaggaattgacgggggcccgcacaagcagtggattatgtggtttaattcgaagcaacgcgaagaaccttaccagggcttgacatcgtactaacgaagcagagatgcattaggtgcccttccggggaaagtatagacaggtggtgcatggttgtcgtcagctcgtgtcgtgagatgttgggttaagtcccgcaacgagcgcaacccctattgtnatttgctacncgagancactctagcgaggctgccgatgacaaaccggaggaaggtggggacgacgtcaaatcatcatgccccttatgtcctgggctacacacgtaatacaatgtctctcacagagggaagcaagaccgcgaggtggagcaaatccctaaaatgcgtctcagttcagattgcaggctgcaactcgcctgcatgaagtcggaattgctagtaatcgcggatcagcatgccgcggtgaatacgttcccgggccttgtacacaccgcccgtcacaccatgagagccgggaacacccgaagtccgtagtctaaccgcaagggggacgcggccgaaggtgggtttggtaattggggtgaagtcgtaacaaggtagccgtatcggaaggtgcggctggatcacctcctt

SEQ ID NO: 311 - DNA, 1517 bp, Artificial Sequence
  Tannerella_sp_6_1_58FAA
agagtttgatcctggctcaggatgaacgctagcgacaggcctaacacatgcaagtcgaggggcaacatggtatcagcttgctgataccgatggcgaccggcgcacgggtgagtaacgcgtatgtaatctacctgtaacagagggataacccggagaaatccggactaatacctcatagcacatattattcgcatgaattttatgttaaagagactcggttacagatgaacatgcgttccattagctggttggcggggtcacggcccaccaaggcaacgatggataggggttctgagaggaaggtcccccacactggtactgagacacggaccagactcctacgggaggcagcagtgaggaatattggtcaatgggcgaagcctgaaccagccaagtcgcgtggaggaagacggccctacgggttgtaaactccttttacctgggaataacgggcgctacgtgtagcgctgtgcatgtaccgggagaataagcatcggctaattccgtgccagcagccgcggtaatacggaagatgcgagcgttatccggatttattgggtttaaagggtgcgtaggcggaaggataagtcagcggtgaaatgcttcagctcaactggagaattgccgatgaaactgtttttctagagtataaaagaggtatgcggaatgcgtggtgtagcggtgaaatgcatagatatcacgcagaaccccgattgcgaaggcagcatactgggctataactgacgctgaagcacgaaagcgtgggtatcgaacaggattagataccctggtagtccacgccgtaaacgatgaatactaactgtttgcgatataatgtaagcggtacagcgaaagcgttaagtattccacctggggagtacgccggcaacggtgaaactcaaaggaattgacgggggcccgcacaagcggaggaacatgtggtttaattcgatgatacgcgaggaaccttacccgggctcaaacgacaggggaataatcccgaaaaggattagccagcaatggccgctgtcgaggtgctgcatggttgtcgtcagctcgtgccgtgaggtgtcggcttaagtgccataacgagcgcaacccttaccggtagttactaacaggtcaagctgaggactctaccgggactgccagcgcaagctgtgaggaaggtggggatgacgtcaaatcagcacggcccttacgtccggggcgacacacgtgttacaatggcaggtacagagagtcgcggcgtagcaatacgtagccaatcccgaaaaacctgtctcagttcggatcggagtctgcaacccgactccgtgaagctggattcgctagtaatcgcgcatcagccatggcgcggtgaatacgttcccgggccttgtacacaccgcccgtcaagccatgggagccgggagtacctgaagtatgcaaccgcaaggagcgtcctagggtaatactggtgactggggctaagtcgtaacaaggtagccgtaccggaaggtgcggctggaacacct

What is claimed is:

1. A method of reducing a side effect of a treatment for a cholestatic disease or condition in a subject in need thereof, comprising administering to the subject a composition which comprises a first bacterial species and a second bacterial species, wherein the first bacterial species and the second bacterial species are not the same, wherein the first bacterial species and the second bacterial species are selected from: *Alistipes finegoldii, Bacteroides uniformis, Bacteroides vulgatus, Bacteroides* sp_3_1_19, *Bacteroides intestinalis, Bacteroides* sp_20_3, *Bacteroides caccae, Bacteroides faecis, Bacteroides* sp_3_1_23, *Bacteroides* sp_D20, *Bacteroides eggerthii, Barnesiella intestinihominis, Bifidobacterium pseudocatenulatum, Blautia schinkii, Blautia wexlerae, Blautia* sp_M25, *Blautia producta, Clostridiales* sp_SM4_1, *Clostridium lavalense, Clostridium innocuum, Clostridium asparagiforme, Clostridium spiroforme, Clostridium hylemonae, Clostridium sordellii, Clostridium* sp_YIT_12069, *Clostridium paraputrificum, Clostridium glycolicum, Clostridium ghonii, Clostridium lactifermentans, Clostridium viride, Clostridium* sp_HGF2, *Clostridium symbiosum, Clostridium scindens, Clostridium disporicum, Clostridium butyricum, Clostridium orbiscindens, Clostridium bolteae, Clostridium* sp_7_2_43FAA, *Collinsella aerofaciens, Coprobacillus* sp_D7, *Coprococcus comes, Coprococcus eutactus, Dorea longicatena, Dorea formicigenerans, Erysipelotrichaceae bacterium_3_1_53, Eubacterium* sp_3_1_31, *Eubacterium* sp_WAL_14571, *Eubacterium limosum, Eubacterium hallii, Eubacterium rectale, Eubacterium contortum, Gemmiger formicillis, Lachnospiraceae bacterium_2_1_58FAA, Lachnospiraceae bacterium_9_1_43BFAA, Lachnospiraceae bacterium_3_1_57FAA_CT1, Lachnospiraceae bacterium_5_1_57FAA, Lachnospiraceae bacterium_oral_taxon_F15, Lactobacillus acidophilus, Lactobacillus gasseri, Parabacteroides distasonis, Pseudoflavonifractor capillosus, Roseburia faecis, Ruminococcus obeum, Ruminococcus bromii, Ruminococcus lactaris,* or *Tannerella* sp_6_1_58FAA, and wherein the first species, the second species, or both are capable of enhancing the efficacy of the treatment, such that the treatment can be administered to the subject at a lower dose, at reduced frequency, or both.

2. The method of claim 1, wherein the first species, the second species, or both are not capable of increasing lithocholic acid (LCA) level in the subject.

3. The method of claim 1, wherein the side effect comprises pruritus.

4. The method of claim 1, wherein the treatment comprises ursodeoxycholic acid (UDCA), obeticholic acid (OCA), or both.

5. The method of claim 1, wherein the first species, the second species, or both are capable of increasing the subject's tolerance for the treatment.

6. The method of claim 1, wherein:
(1) the *Alistipes finegoldii* comprises a 16S rDNA sequence that is at least 95% identical to the sequence set forth in SEQ ID NO: 7;
(2) the *Bacteroides uniformis* comprises a 16S rDNA sequence that is at least 95% identical to the sequence set forth in SEQ ID NO: 45;
(3) the *Bacteroides vulgatus* comprises a 16S rDNA sequence that is at least 95% identical to the sequence set forth in any one of SEQ ID NO: 53, SEQ ID NO: 54, SEQ ID NO: 55, or a combination thereof;
(4) the *Bacteroides* sp_3_1_19 comprises a 16S rDNA sequence that is at least 95% identical to the sequence set forth in SEQ ID NO: 33;
(5) the *Bacteroides intestinalis* comprises a 16S rDNA sequence that is at least 95% identical to the sequence set forth in SEQ ID NO: 22;
(6) the *Bacteroides* sp_20_3 comprises a 16S rDNA sequence that is at least 95% identical to the sequence set forth in SEQ ID NO: 20;
(7) the *Bacteroides caccae* comprises a 16S rDNA sequence that is at least 95% identical to the sequence set forth in SEQ ID NO: 9, SEQ ID NO: 10, or both;
(8) the *Bacteroides faecis* comprises a 16S rDNA sequence that is at least 95% identical to the sequence set forth in SEQ ID NO: 13;
(9) the *Bacteroides* sp_3_1_23 comprises a 16S rDNA sequence that is at least 95% identical to the sequence set forth in SEQ ID NO: 34;
(10) the *Bacteroides* sp_D20 comprises a 16S rDNA sequence that is at least 95% identical to the sequence set forth in SEQ ID NO: 39;
(11) the *Bacteroides eggerthii* comprises a 16S rDNA sequence that is at least 95% identical to the sequence set forth in SEQ ID NO: 12;
(12) the *Barnesiella intestinihominis* comprises a 16S rDNA sequence that is at least 95% identical to the sequence set forth in SEQ ID NO: 59;
(13) the *Bifidobacterium pseudocatenulatum* comprises a 16S rDNA sequence that is at least 95% identical to the sequence set forth in SEQ ID NO: 113, SEQ ID NO: 114, or both;
(14) the *Blautia schinkii* comprises a 16S rDNA sequence that is at least 95% identical to the sequence set forth in SEQ ID NO: 130;
(15) the *Blautia wexlerae* comprises a 16S rDNA sequence that is at least 95% identical to the sequence set forth in SEQ ID NO: 133;
(16) the *Blautia* sp_M25 comprises a 16S rDNA sequence that is at least 95% identical to the sequence set forth in SEQ ID NO: 131;
(17) the *Blautia producta* comprises a 16S rDNA sequence that is at least 95% identical to the sequence set forth in SEQ ID NO: 128, SEQ ID NO: 129, or both;

(18) the *Clostridiales* sp_SM4_1 comprises a 16S rDNA sequence that is at least 95% identical to the sequence set forth in SEQ ID NO: 142;
(19) the *Clostridium lavalense* comprises a 16S rDNA sequence that is at least 95% identical to the sequence set forth in SEQ ID NO: 184;
(20) the *Clostridium innocuum* comprises a 16S rDNA sequence that is at least 95% identical to the sequence set forth in any one of SEQ ID NO: 179, SEQ ID NO: 180, SEQ ID NO: 181, SEQ ID NO: 182, or a combination thereof;
(21) the *Clostridium asparagiforme* comprises a 16S rDNA sequence that is at least 95% identical to the sequence set forth in SEQ ID NO: 143;
(22) the *Clostridium spiroforme* comprises a 16S rDNA sequence that is at least 95% identical to the sequence set forth in SEQ ID NO: 194;
(23) the *Clostridium hylemonae* comprises a 16S rDNA sequence that is at least 95% identical to the sequence set forth in any one of SEQ ID NO: 176, SEQ ID NO: 177, SEQ ID NO: 178, or a combination thereof;
(24) the *Clostridium sordellii* comprises a 16S rDNA sequence that is at least 95% identical to the sequence set forth in SEQ ID NO: 190;
(25) the *Clostridium* sp_YIT_12069 comprises a 16S rDNA sequence that is at least 95% identical to the sequence set forth in SEQ ID NO: 197;
(26) the *Clostridium paraputrificum* comprises a 16S rDNA sequence that is at least 95% identical to the sequence set forth in SEQ ID NO: 188;
(27) the *Clostridium glycolicum* comprises a 16S rDNA sequence that is at least 95% identical to the sequence set forth in SEQ ID NO: 173;
(28) the *Clostridium ghonii* comprises a 16S rDNA sequence that is at least 95% identical to the sequence set forth in SEQ ID NO: 172;
(29) the *Clostridium viride* comprises a 16S rDNA sequence that is at least 95% identical to the sequence set forth in SEQ ID NO: 200;
(30) the *Clostridium* sp_HGF2 comprises a 16S rDNA sequence that is at least 95% identical to the sequence set forth in SEQ ID NO: 193;
(31) the *Clostridium symbiosum* comprises a 16S rDNA sequence that is at least 95% identical to the sequence set forth in SEQ ID NO: 198, SEQ ID NO: 199, or both;
(32) the *Clostridium scindens* comprises a 16S rDNA sequence that is at least 95% identical to the sequence set forth in SEQ ID NO: 189;
(33) the *Clostridium disporicum* comprises a 16S rDNA sequence that is at least 95% identical to the sequence set forth in SEQ ID NO: 170, SEQ ID NO: 171, or both;
(34) the *Clostridium butyricum* comprises a 16S rDNA sequence that is at least 95% identical to the sequence set forth in SEQ ID NO: 150, SEQ ID NO: 151, or both;
(35) the *Clostridium orbiscindens* comprises a 16S rDNA sequence that is at least 95% identical to the sequence set forth in SEQ ID NO: 186;
(36) the *Clostridium bolteae* comprises a 16S rDNA sequence that is at least 95% identical to the sequence set forth in SEQ ID NO: 149;
(37) the *Clostridium* sp_7_2_43FAA comprises a 16S rDNA sequence that is at least 95% identical to the sequence set forth in SEQ ID NO: 191;
(38) the *Collinsella aerofaciens* comprises a 16S rDNA sequence that is at least 95% identical to the sequence set forth in SEQ ID NO: 201;
(39) the *Coprobacillus* sp_D7 comprises a 16S rDNA sequence that is at least 95% identical to the sequence set forth in SEQ ID NO: 206;
(40) the *Coprococcus comes* comprises a 16S rDNA sequence that is at least 95% identical to the sequence set forth in SEQ ID NO: 207;
(41) the *Coprococcus eutactus* comprises a 16S rDNA sequence that is at least 95% identical to the sequence set forth in SEQ ID NO: 208;
(42) the *Dorea longicatena* comprises a 16S rDNA sequence that is at least 95% identical to the sequence set forth in SEQ ID NO: 211;
(43) the *Dorea formicigenerans* comprises a 16S rDNA sequence that is at least 95% identical to the sequence set forth in SEQ ID NO: 210;
(44) the *Erysipelotrichaceae bacterium*_3_1_53 comprises a 16S rDNA sequence that is at least 95% identical to the sequence set forth in SEQ ID NO: 214;
(45) the *Eubacterium* sp_3_1_31 comprises a 16S rDNA sequence that is at least 95% identical to the sequence set forth in SEQ ID NO: 227;
(46) the *Eubacterium* sp_WAL_14571 comprises a 16S rDNA sequence that is at least 95% identical to the sequence set forth in SEQ ID NO: 229;
(47) the *Eubacterium limosum* comprises a 16S rDNA sequence that is at least 95% identical to the sequence set forth in SEQ ID NO: 222;
(48) the *Eubacterium hallii* comprises a 16S rDNA sequence that is at least 95% identical to the sequence set forth in SEQ ID NO: 220, SEQ ID NO: 221, or both;
(49) the *Eubacterium rectale* comprises a 16S rDNA sequence that is at least 95% identical to the sequence set forth in any one of SEQ ID NO: 223, SEQ ID NO: 224, SEQ ID NO: 225, SEQ ID NO: 226, or a combination thereof;
(50) the *Eubacterium contortum* comprises a 16S rDNA sequence that is at least 95% identical to the sequence set forth in SEQ ID NO: 217;
(51) the *Lachnospiraceae bacterium*_2_1_58FAA comprises a 16S rDNA sequence that is at least 95% identical to the sequence set forth in SEQ ID NO: 244;
(52) the *Lachnospiraceae bacterium*_9_1_43BFAA comprises a 16S rDNA sequence that is at least 95% identical to the sequence set forth in SEQ ID NO: 250;
(53) the *Lachnospiraceae bacterium*_3_1_57FAA_CT1 comprises a 16S rDNA sequence that is at least 95% identical to the sequence set forth in SEQ ID NO: 245;
(54) the *Lachnospiraceae bacterium*_5_1_57FAA comprises a 16S rDNA sequence that is at least 95% identical to the sequence set forth in SEQ ID NO: 247;
(55) the *Lachnospiraceae bacterium*_oral_taxon_F15 comprises a 16S rDNA sequence that is at least 95% identical to the sequence set forth in SEQ ID NO: 251;
(56) the *Lactobacillus acidophilus* comprises a 16S rDNA sequence that is at least 95% identical to the sequence set forth in SEQ ID NO: 252, SEQ ID NO: 253, or both;
(57) the *Lactobacillus gasseri* comprises a 16S rDNA sequence that is at least 95% identical to the sequence set forth in any one of SEQ ID NO: 260, SEQ ID NO: 261, SEQ ID NO: 262, SEQ ID NO: 263, SEQ ID NO: 264, SEQ ID NO: 265, SEQ ID NO: 266, or a combination thereof;
(58) the *Parabacteroides distasonis* comprises a 16S rDNA sequence that is at least 95% identical to the sequence set forth in any one of SEQ ID NO: 272, SEQ ID NO: 273, SEQ ID NO: 274, SEQ ID NO: 274, SEQ ID NO: 275, SEQ ID NO: 276, SEQ ID NO: 277, SEQ ID NO: 278, or a combination thereof;
(59) the *Pseudoflavonifractor capillosus* comprises a 16S rDNA sequence that is at least 95% identical to the sequence set forth in SEQ ID NO: 292;
(60) the *Roseburia faecis* comprises a 16S rDNA sequence that is at least 95% identical to the sequence set forth in SEQ ID NO: 294;
(61) the *Ruminococcus obeum* comprises a 16S rDNA sequence that is at least 95% identical to the sequence set forth in any one of SEQ ID NO: 303, SEQ ID NO: 304, SEQ ID NO: 305, or a combination thereof;
(62) the *Ruminococcus bromii* comprises a 16S rDNA sequence that is at least 95% identical to the sequence set forth in SEQ ID NO: 299, SEQ ID NO: 300, or both;
(63) the *Ruminococcus lactaris* comprises a 16S rDNA sequence that is at least 95% identical to the sequence set forth in SEQ ID NO: 302; or
(64) the *Tannerella* sp_6_1_58FAA comprises a 16S rDNA sequence that is at least 95% identical to the sequence set forth in SEQ ID NO: 311.

7. A method of enhancing an efficacy of a treatment for a cholestatic disease or condition in a subject in need thereof, comprising administering to the subject the treatment and a composition comprising a first bacterial species and a second bacterial species, wherein the first bacterial species and the second bacterial species are not the same, and wherein the first bacterial species and the second bacterial species are selected from: *Alistipes finegoldii, Bacteroides uniformis, Bacteroides vulgatus, Bacteroides* sp_3_1_19, *Bacteroides intestinalis, Bacteroides* sp_20_3, *Bacteroides caccae, Bacteroides faecis, Bacteroides* sp_3_1_23, *Bacteroides* sp_D20, *Bacteroides eggerthii, Barnesiella intestinihominis, Bifidobacterium pseudocatenulatum, Blautia schinkii, Blautia wexlerae, Blautia* sp_M25, *Blautia producta, Clostridiales* sp_SM4_1, *Clostridium lavalense, Clostridium innocuum, Clostridium asparagiforme, Clostridium spiroforme, Clostridium hylemonae, Clostridium sordellii, Clostridium* sp_YIT_12069, *Clostridium paraputrificum, Clostridium glycolicum, Clostridium ghonii, Clostridium lactifermentans, Clostridium viride, Clostridium* sp_HGF2, *Clostridium symbiosum, Clostridium scindens, Clostridium disporicum, Clostridium butyricum, Clostridium orbiscindens, Clostridium bolteae, Clostridium* sp_7_2_43FAA, *Collinsella aerofaciens, Coprobacillus* sp_D7, *Coprococcus comes, Coprococcus eutactus, Dorea longicatena, Dorea formicigenerans, Erysipelotrichaceae* bacterium_3_1_53, *Eubacterium* sp_3_1_31, *Eubacterium* sp_WAL_14571, *Eubacterium limosum, Eubacterium hallii, Eubacterium rectale, Eubacterium contortum, Gemmiger formicillis, Lachnospiraceae* bacterium_2_1_58FAA, *Lachnospiraceae* bacterium_9_1_43BFAA, *Lachnospiraceae* bacterium_3_1_57FAA_CT1, *Lachnospiraceae* bacterium_5_1_57FAA, *Lachnospiraceae* bacterium_oral_taxon_F15, *Lactobacillus acidophilus, Lactobacillus gasseri, Parabacteroides distasonis, Pseudoflavonifractor capillosus, Roseburia faecis, Ruminococcus obeum, Ruminococcus bromii, Ruminococcus lactaris,* or *Tannerella* sp_6_1_58FAA.

8. The method of claim 7, wherein the treatment comprises ursodeoxycholic acid (UDCA), obeticholic acid (OCA), or both.

9. The method of claim 7, wherein:
(1) the *Alistipes finegoldii* comprises a 16S rDNA sequence that is at least 95% identical to the sequence set forth in SEQ ID NO: 7;
(2) the *Bacteroides uniformis* comprises a 16S rDNA sequence that is at least 95% identical to the sequence set forth in SEQ ID NO: 45;
(3) the *Bacteroides vulgatus* comprises a 16S rDNA sequence that is at least 95% identical to the sequence set forth in any one of SEQ ID NO: 53, SEQ ID NO: 54, SEQ ID NO: 55, or a combination thereof;
(4) the *Bacteroides* sp_3_1_19 comprises a 16S rDNA sequence that is at least 95% identical to the sequence set forth in SEQ ID NO: 33;
(5) the *Bacteroides intestinalis* comprises a 16S rDNA sequence that is at least 95% identical to the sequence set forth in SEQ ID NO: 22;
(6) the *Bacteroides* sp_20_3 comprises a 16S rDNA sequence that is at least 95% identical to the sequence set forth in SEQ ID NO: 20;
(7) the *Bacteroides caccae* comprises a 16S rDNA sequence that is at least 95% identical to the sequence set forth in SEQ ID NO: 9, SEQ ID NO: 10, or both;
(8) the *Bacteroides faecis* comprises a 16S rDNA sequence that is at least 95% identical to the sequence set forth in SEQ ID NO: 13;
(9) the *Bacteroides* sp_3_1_23 comprises a 16S rDNA sequence that is at least 95% identical to the sequence set forth in SEQ ID NO: 34;
(10) the *Bacteroides* sp_D20 comprises a 16S rDNA sequence that is at least 95% identical to the sequence set forth in SEQ ID NO: 39;
(11) the *Bacteroides eggerthii* comprises a 16S rDNA sequence that is at least 95% identical to the sequence set forth in SEQ ID NO: 12;
(12) the *Barnesiella intestinihominis* comprises a 16S rDNA sequence that is at least 95% identical to the sequence set forth in SEQ ID NO: 59;
(13) the *Bifidobacterium pseudocatenulatum* comprises a 16S rDNA sequence that is at least 95% identical to the sequence set forth in SEQ ID NO: 113, SEQ ID NO: 114, or both;
(14) the *Blautia schinkii* comprises a 16S rDNA sequence that is at least 95% identical to the sequence set forth in SEQ ID NO: 130;
(15) the *Blautia wexlerae* comprises a 16S rDNA sequence that is at least 95% identical to the sequence set forth in SEQ ID NO: 133;
(16) the *Blautia* sp_M25 comprises a 16S rDNA sequence that is at least 95% identical to the sequence set forth in SEQ ID NO: 131;
(17) the *Blautia producta* comprises a 16S rDNA sequence that is at least 95% identical to the sequence set forth in SEQ ID NO: 128, SEQ ID NO: 129, or both;
(18) the *Clostridiales* sp_SM4_1 comprises a 16S rDNA sequence that is at least 95% identical to the sequence set forth in SEQ ID NO: 142;
(19) the *Clostridium lavalense* comprises a 16S rDNA sequence that is at least 95% identical to the sequence set forth in SEQ ID NO: 184;
(20) the *Clostridium innocuum* comprises a 16S rDNA sequence that is at least 95% identical to the sequence set forth in any one of SEQ ID NO: 179, SEQ ID NO: 180, SEQ ID NO: 181, SEQ ID NO: 182, or a combination thereof;
(21) the *Clostridium asparagiforme* comprises a 16S rDNA sequence that is at least 95% identical to the sequence set forth in SEQ ID NO: 143;
(22) the *Clostridium spiroforme* comprises a 16S rDNA sequence that is at least 95% identical to the sequence set forth in SEQ ID NO: 194;

(23) the *Clostridium hylemonae* comprises a 16S rDNA sequence that is at least 95% identical to the sequence set forth in any one of SEQ ID NO: 176, SEQ ID NO: 177, SEQ ID NO: 178, or a combination thereof;

(24) the *Clostridium sordellii* comprises a 16S rDNA sequence that is at least 95% identical to the sequence set forth in SEQ ID NO: 190;

(25) the *Clostridium sp_YIT_12069* comprises a 16S rDNA sequence that is at least 95% identical to the sequence set forth in SEQ ID NO: 197;

(26) the *Clostridium paraputrificum* comprises a 16S rDNA sequence that is at least 95% identical to the sequence set forth in SEQ ID NO: 188;

(27) the *Clostridium glycolicum* comprises a 16S rDNA sequence that is at least 95% identical to the sequence set forth in SEQ ID NO: 173;

(28) the *Clostridium ghonii* comprises a 16S rDNA sequence that is at least 95% identical to the sequence set forth in SEQ ID NO: 172;

(29) the *Clostridium viride* comprises a 16S rDNA sequence that is at least 95% identical to the sequence set forth in SEQ ID NO: 200;

(30) the *Clostridium sp_HGF2* comprises a 16S rDNA sequence that is at least 95% identical to the sequence set forth in SEQ ID NO: 193;

(31) the *Clostridium symbiosum* comprises a 16S rDNA sequence that is at least 95% identical to the sequence set forth in SEQ ID NO: 198, SEQ ID NO: 199, or both;

(32) the *Clostridium scindens* comprises a 16S rDNA sequence that is at least 95% identical to the sequence set forth in SEQ ID NO: 189;

(33) the *Clostridium disporicum* comprises a 16S rDNA sequence that is at least 95% identical to the sequence set forth in SEQ ID NO: 170, SEQ ID NO: 171, or both;

(34) the *Clostridium butyricum* comprises a 16S rDNA sequence that is at least 95% identical to the sequence set forth in SEQ ID NO: 150, SEQ ID NO: 151, or both;

(35) the *Clostridium orbiscindens* comprises a 16S rDNA sequence that is at least 95% identical to the sequence set forth in SEQ ID NO: 186;

(36) the *Clostridium bolteae* comprises a 16S rDNA sequence that is at least 95% identical to the sequence set forth in SEQ ID NO: 149;

(37) the *Clostridium sp_7_2_43FAA* comprises a 16S rDNA sequence that is at least 95% identical to the sequence set forth in SEQ ID NO: 191;

(38) the *Collinsella aerofaciens* comprises a 16S rDNA sequence that is at least 95% identical to the sequence set forth in SEQ ID NO: 201;

(39) the *Coprobacillus sp_D7* comprises a 16S rDNA sequence that is at least 95% identical to the sequence set forth in SEQ ID NO: 206;

(40) the *Coprococcus comes* comprises a 16S rDNA sequence that is at least 95% identical to the sequence set forth in SEQ ID NO: 207;

(41) the *Coprococcus eutactus* comprises a 16S rDNA sequence that is at least 95% identical to the sequence set forth in SEQ ID NO: 208;

(42) the *Dorea longicatena* comprises a 16S rDNA sequence that is at least 95% identical to the sequence set forth in SEQ ID NO: 211;

(43) the *Dorea formicigenerans* comprises a 16S rDNA sequence that is at least 95% identical to the sequence set forth in SEQ ID NO: 210;

(44) the *Erysipelotrichaceae bacterium_3_1_53* comprises a 16S rDNA sequence that is at least 95% identical to the sequence set forth in SEQ ID NO: 214;

(45) the *Eubacterium sp_3_1_31* comprises a 16S rDNA sequence that is at least 95% identical to the sequence set forth in SEQ ID NO: 227;

(46) the *Eubacterium sp_WAL_14571* comprises a 16S rDNA sequence that is at least 95% identical to the sequence set forth in SEQ ID NO: 229;

(47) the *Eubacterium limosum* comprises a 16S rDNA sequence that is at least 95% identical to the sequence set forth in SEQ ID NO: 222;

(48) the *Eubacterium hallii* comprises a 16S rDNA sequence that is at least 95% identical to the sequence set forth in SEQ ID NO: 220, SEQ ID NO: 221, or both;

(49) the *Eubacterium rectale* comprises a 16S rDNA sequence that is at least 95% identical to the sequence set forth in any one of SEQ ID NO: 223, SEQ ID NO: 224, SEQ ID NO: 225, SEQ ID NO: 226, or a combination thereof;

(50) the *Eubacterium contortum* comprises a 16S rDNA sequence that is at least 95% identical to the sequence set forth in SEQ ID NO: 217;

(51) the *Lachnospiraceae bacterium_2_1_58FAA* comprises a 16S rDNA sequence that is at least 95% identical to the sequence set forth in SEQ ID NO: 244;

(52) the *Lachnospiraceae bacterium_9_1_43BFAA* comprises a 16S rDNA sequence that is at least 95% identical to the sequence set forth in SEQ ID NO: 250;

(53) the *Lachnospiraceae bacterium_3_1_57FAA_CT1* comprises a 16S rDNA sequence that is at least 95% identical to the sequence set forth in SEQ ID NO: 245;

(54) the *Lachnospiraceae bacterium_5_1_57FAA* comprises a 16S rDNA sequence that is at least 95% identical to the sequence set forth in SEQ ID NO: 247;

(55) the *Lachnospiraceae bacterium_oral_taxon_F15* comprises a 16S rDNA sequence that is at least 95% identical to the sequence set forth in SEQ ID NO: 251;

(56) the *Lactobacillus acidophilus* comprises a 16S rDNA sequence that is at least 95% identical to the sequence set forth in SEQ ID NO: 252, SEQ ID NO: 253, or both;

(57) the *Lactobacillus gasseri* comprises a 16S rDNA sequence that is at least 95% identical to the sequence set forth in any one of SEQ ID NO: 260, SEQ ID NO: 261, SEQ ID NO: 262, SEQ ID NO: 263, SEQ ID NO: 264, SEQ ID NO: 265, SEQ ID NO: 266, or a combination thereof;

(58) the *Parabacteroides distasonis* comprises a 16S rDNA sequence that is at least 95% identical to the sequence set forth in any one of SEQ ID NO: 272, SEQ ID NO: 273, SEQ ID NO: 274, SEQ ID NO: 274, SEQ ID NO: 275, SEQ ID NO: 276, SEQ ID NO: 277, SEQ ID NO: 278, or a combination thereof;

(59) the *Pseudoflavonifractor capillosus* comprises a 16S rDNA sequence that is at least 95% identical to the sequence set forth in SEQ ID NO: 292;

(60) the *Roseburia faecis* comprises a 16S rDNA sequence that is at least 95% identical to the sequence set forth in SEQ ID NO: 294;

(61) the *Ruminococcus obeum* comprises a 16S rDNA sequence that is at least 95% identical to the sequence set forth in any one of SEQ ID NO: 303, SEQ ID NO: 304, SEQ ID NO: 305, or a combination thereof;

(62) the *Ruminococcus bromii* comprises a 16S rDNA sequence that is at least 95% identical to the sequence set forth in SEQ ID NO: 299, SEQ ID NO: 300, or both;

(63) the *Ruminococcus lactaris* comprises a 16S rDNA sequence that is at least 95% identical to the sequence set forth in SEQ ID NO: 302; or

(64) the *Tannerella* sp_6_1_58FAA comprises a 16S rDNA sequence that is at least 95% identical to the sequence set forth in SEQ ID NO: 311.

10. The method of claim 1, wherein:
(1) the *Alistipes finegoldii* comprises a 16S rDNA sequence that is at least 97% identical to the sequence set forth in SEQ ID NO: 7;
(2) the *Bacteroides uniformis* comprises a 16S rDNA sequence that is at least 97% identical to the sequence set forth in SEQ ID NO: 45;
(3) the *Bacteroides vulgatus* comprises a 16S rDNA sequence that is at least 97% identical to the sequence set forth in any one of SEQ ID NO: 53, SEQ ID NO: 54, SEQ ID NO: 55, or a combination thereof;
(4) the *Bacteroides* sp_3_1_19 comprises a 16S rDNA sequence that is at least 97% identical to the sequence set forth in SEQ ID NO: 33;
(5) the *Bacteroides intestinalis* comprises a 16S rDNA sequence that is at least 97% identical to the sequence set forth in SEQ ID NO: 22;
(6) the *Bacteroides* sp_20_3 comprises a 16S rDNA sequence that is at least 97% identical to the sequence set forth in SEQ ID NO: 20;
(7) the *Bacteroides caccae* comprises a 16S rDNA sequence that is at least 97% identical to the sequence set forth in SEQ ID NO: 9, SEQ ID NO: 10, or both;
(8) the *Bacteroides faecis* comprises a 16S rDNA sequence that is at least 97% identical to the sequence set forth in SEQ ID NO: 13;
(9) the *Bacteroides* sp_3_1_23 comprises a 16S rDNA sequence that is at least 97% identical to the sequence set forth in SEQ ID NO: 34;
(10) the *Bacteroides* sp_D20 comprises a 16S rDNA sequence that is at least 97% identical to the sequence set forth in SEQ ID NO: 39;
(11) the *Bacteroides eggerthii* comprises a 16S rDNA sequence that is at least 97% identical to the sequence set forth in SEQ ID NO: 12;
(12) the *Barnesiella intestinihominis* comprises a 16S rDNA sequence that is at least 97% identical to the sequence set forth in SEQ ID NO: 59;
(13) the *Bifidobacterium pseudocatenulatum* comprises a 16S rDNA sequence that is at least 97% identical to the sequence set forth in SEQ ID NO: 113, SEQ ID NO: 114, or both;
(14) the *Blautia schinkii* comprises a 16S rDNA sequence that is at least 97% identical to the sequence set forth in SEQ ID NO: 130;
(15) the *Blautia wexlerae* comprises a 16S rDNA sequence that is at least 97% identical to the sequence set forth in SEQ ID NO: 133;
(16) the *Blautia* sp_M25 comprises a 16S rDNA sequence that is at least 97% identical to the sequence set forth in SEQ ID NO: 131;
(17) the *Blautia producta* comprises a 16S rDNA sequence that is at least 97% identical to the sequence set forth in SEQ ID NO: 128, SEQ ID NO: 129, or both;
(18) the *Clostridiales* sp_SM4_1 comprises a 16S rDNA sequence that is at least 97% identical to the sequence set forth in SEQ ID NO: 142;
(19) the *Clostridium lavalense* comprises a 16S rDNA sequence that is at least 97% identical to the sequence set forth in SEQ ID NO: 184;
(20) the *Clostridium innocuum* comprises a 16S rDNA sequence that is at least 97% identical to the sequence set forth in any one of SEQ ID NO: 179, SEQ ID NO: 180, SEQ ID NO: 181, SEQ ID NO: 182, or a combination thereof;
(21) the *Clostridium asparagiforme* comprises a 16S rDNA sequence that is at least 97% identical to the sequence set forth in SEQ ID NO: 143;
(22) the *Clostridium spiroforme* comprises a 16S rDNA sequence that is at least 97% identical to the sequence set forth in SEQ ID NO: 194;
(23) the *Clostridium hylemonae* comprises a 16S rDNA sequence that is at least 97% identical to the sequence set forth in any one of SEQ ID NO: 176, SEQ ID NO: 177, SEQ ID NO: 178, or a combination thereof;
(24) the *Clostridium sordellii* comprises a 16S rDNA sequence that is at least 97% identical to the sequence set forth in SEQ ID NO: 190;
(25) the *Clostridium* sp_YIT_12069 comprises a 16S rDNA sequence that is at least 97% identical to the sequence set forth in SEQ ID NO: 197;
(26) the *Clostridium paraputrificum* comprises a 16S rDNA sequence that is at least 97% identical to the sequence set forth in SEQ ID NO: 188;
(27) the *Clostridium glycolicum* comprises a 16S rDNA sequence that is at least 97% identical to the sequence set forth in SEQ ID NO: 173;
(28) the *Clostridium ghonii* comprises a 16S rDNA sequence that is at least 97% identical to the sequence set forth in SEQ ID NO: 172;
(29) the *Clostridium viride* comprises a 16S rDNA sequence that is at least 97% identical to the sequence set forth in SEQ ID NO: 200;
(30) the *Clostridium* sp_HGF2 comprises a 16S rDNA sequence that is at least 97% identical to the sequence set forth in SEQ ID NO: 193;
(31) the *Clostridium symbiosum* comprises a 16S rDNA sequence that is at least 97% identical to the sequence set forth in SEQ ID NO: 198, SEQ ID NO: 199, or both;
(32) the *Clostridium scindens* comprises a 16S rDNA sequence that is at least 97% identical to the sequence set forth in SEQ ID NO: 189;
(33) the *Clostridium disporicum* comprises a 16S rDNA sequence that is at least 97% identical to the sequence set forth in SEQ ID NO: 170, SEQ ID NO: 171, or both;
(34) the *Clostridium butyricum* comprises a 16S rDNA sequence that is at least 97% identical to the sequence set forth in SEQ ID NO: 150, SEQ ID NO: 151, or both;
(35) the *Clostridium orbiscindens* comprises a 16S rDNA sequence that is at least 97% identical to the sequence set forth in SEQ ID NO: 186;
(36) the *Clostridium bolteae* comprises a 16S rDNA sequence that is at least 97% identical to the sequence set forth in SEQ ID NO: 149;
(37) the *Clostridium* sp_7_2_43FAA comprises a 16S rDNA sequence that is at least 97% identical to the sequence set forth in SEQ ID NO: 191;
(38) the *Collinsella aerofaciens* comprises a 16S rDNA sequence that is at least 97% identical to the sequence set forth in SEQ ID NO: 201;
(39) the *Coprobacillus* sp_D7 comprises a 16S rDNA sequence that is at least 97% identical to the sequence set forth in SEQ ID NO: 206;
(40) the *Coprococcus comes* comprises a 16S rDNA sequence that is at least 97% identical to the sequence set forth in SEQ ID NO: 207;
(41) the *Coprococcus eutactus* comprises a 16S rDNA sequence that is at least 97% identical to the sequence set forth in SEQ ID NO: 208;

(42) the *Dorea longicatena* comprises a 16S rDNA sequence that is at least 97% identical to the sequence set forth in SEQ ID NO: 211;

(43) the *Dorea formicigenerans* comprises a 16S rDNA sequence that is at least 97% identical to the sequence set forth in SEQ ID NO: 210;

(44) the *Erysipelotrichaceae bacterium*_3_1_53 comprises a 16S rDNA sequence that is at least 97% identical to the sequence set forth in SEQ ID NO: 214;

(45) the *Eubacterium* sp_3_1_31 comprises a 16S rDNA sequence that is at least 97% identical to the sequence set forth in SEQ ID NO: 227;

(46) the *Eubacterium* sp_WAL_14571 comprises a 16S rDNA sequence that is at least 97% identical to the sequence set forth in SEQ ID NO: 229;

(47) the *Eubacterium limosum* comprises a 16S rDNA sequence that is at least 97% identical to the sequence set forth in SEQ ID NO: 222;

(48) the *Eubacterium hallii* comprises a 16S rDNA sequence that is at least 97% identical to the sequence set forth in SEQ ID NO: 220, SEQ ID NO: 221, or both;

(49) the *Eubacterium rectale* comprises a 16S rDNA sequence that is at least 97% identical to the sequence set forth in any one of SEQ ID NO: 223, SEQ ID NO: 224, SEQ ID NO: 225, SEQ ID NO: 226, or a combination thereof;

(50) the *Eubacterium contortum* comprises a 16S rDNA sequence that is at least 97% identical to the sequence set forth in SEQ ID NO: 217;

(51) the *Lachnospiraceae bacterium*_2_1_58FAA comprises a 16S rDNA sequence that is at least 97% identical to the sequence set forth in SEQ ID NO: 244;

(52) the *Lachnospiraceae bacterium*_9_1_43BFAA comprises a 16S rDNA sequence that is at least 97% identical to the sequence set forth in SEQ ID NO: 250;

(53) the *Lachnospiraceae bacterium*_3_1_57FAA_CT1 comprises a 16S rDNA sequence that is at least 97% identical to the sequence set forth in SEQ ID NO: 245;

(54) the *Lachnospiraceae bacterium*_5_1_57FAA comprises a 16S rDNA sequence that is at least 97% identical to the sequence set forth in SEQ ID NO: 247;

(55) the *Lachnospiraceae bacterium*_oral_taxon_F15 comprises a 16S rDNA sequence that is at least 97% identical to the sequence set forth in SEQ ID NO: 251;

(56) the *Lactobacillus acidophilus* comprises a 16S rDNA sequence that is at least 97% identical to the sequence set forth in SEQ ID NO: 252, SEQ ID NO: 253, or both;

(57) the *Lactobacillus gasseri* comprises a 16S rDNA sequence that is at least 97% identical to the sequence set forth in any one of SEQ ID NO: 260, SEQ ID NO: 261, SEQ ID NO: 262, SEQ ID NO: 263, SEQ ID NO: 264, SEQ ID NO: 265, SEQ ID NO: 266, or a combination thereof;

(58) the *Parabacteroides distasonis* comprises a 16S rDNA sequence that is at least 97% identical to the sequence set forth in any one of SEQ ID NO: 272, SEQ ID NO: 273, SEQ ID NO: 274, SEQ ID NO: 274, SEQ ID NO: 275, SEQ ID NO: 276, SEQ ID NO: 277, SEQ ID NO: 278, or a combination thereof;

(59) the *Pseudoflavonifractor capillosus* comprises a 16S rDNA sequence that is at least 97% identical to the sequence set forth in SEQ ID NO: 292;

(60) the *Roseburia faecis* comprises a 16S rDNA sequence that is at least 97% identical to the sequence set forth in SEQ ID NO: 294;

(61) the *Ruminococcus obeum* comprises a 16S rDNA sequence that is at least 97% identical to the sequence set forth in any one of SEQ ID NO: 303, SEQ ID NO: 304, SEQ ID NO: 305, or a combination thereof;

(62) the *Ruminococcus bromii* comprises a 16S rDNA sequence that is at least 97% identical to the sequence set forth in SEQ ID NO: 299, SEQ ID NO: 300, or both;

(63) the *Ruminococcus lactaris* comprises a 16S rDNA sequence that is at least 97% identical to the sequence set forth in SEQ ID NO: 302; or

(64) the *Tannerella* sp_6_1_58FAA comprises a 16S rDNA sequence that is at least 97% identical to the sequence set forth in SEQ ID NO: 311.

11. The method of claim 7, wherein:

(1) the *Alistipes finegoldii* comprises a 16S rDNA sequence that is at least 97% identical to the sequence set forth in SEQ ID NO: 7;

(2) the *Bacteroides uniformis* comprises a 16S rDNA sequence that is at least 97% identical to the sequence set forth in SEQ ID NO: 45;

(3) the *Bacteroides vulgatus* comprises a 16S rDNA sequence that is at least 97% identical to the sequence set forth in any one of SEQ ID NO: 53, SEQ ID NO: 54, SEQ ID NO: 55, or a combination thereof;

(4) the *Bacteroides* sp_3_1_19 comprises a 16S rDNA sequence that is at least 97% identical to the sequence set forth in SEQ ID NO: 33;

(5) the *Bacteroides intestinalis* comprises a 16S rDNA sequence that is at least 97% identical to the sequence set forth in SEQ ID NO: 22;

(6) the *Bacteroides* sp_20_3 comprises a 16S rDNA sequence that is at least 97% identical to the sequence set forth in SEQ ID NO: 20;

(7) the *Bacteroides caccae* comprises a 16S rDNA sequence that is at least 97% identical to the sequence set forth in SEQ ID NO: 9, SEQ ID NO: 10, or both;

(8) the *Bacteroides faecis* comprises a 16S rDNA sequence that is at least 97% identical to the sequence set forth in SEQ ID NO: 13;

(9) the *Bacteroides* sp_3_1_23 comprises a 16S rDNA sequence that is at least 97% identical to the sequence set forth in SEQ ID NO: 34;

(10) the *Bacteroides* sp_D20 comprises a 16S rDNA sequence that is at least 97% identical to the sequence set forth in SEQ ID NO: 39;

(11) the *Bacteroides eggerthii* comprises a 16S rDNA sequence that is at least 97% identical to the sequence set forth in SEQ ID NO: 12;

(12) the *Barnesiella intestinihominis* comprises a 16S rDNA sequence that is at least 97% identical to the sequence set forth in SEQ ID NO: 59;

(13) the *Bifidobacterium pseudocatenulatum* comprises a 16S rDNA sequence that is at least 97% identical to the sequence set forth in SEQ ID NO: 113, SEQ ID NO: 114, or both;

(14) the *Blautia schinkii* comprises a 16S rDNA sequence that is at least 97% identical to the sequence set forth in SEQ ID NO: 130;

(15) the *Blautia wexlerae* comprises a 16S rDNA sequence that is at least 97% identical to the sequence set forth in SEQ ID NO: 133;

(16) the *Blautia* sp_M25 comprises a 16S rDNA sequence that is at least 97% identical to the sequence set forth in SEQ ID NO: 131;

(17) the *Blautia producta* comprises a 16S rDNA sequence that is at least 97% identical to the sequence set forth in SEQ ID NO: 128, SEQ ID NO: 129, or both;

(18) the *Clostridiales* sp_SM4_1 comprises a 16S rDNA sequence that is at least 97% identical to the sequence set forth in SEQ ID NO: 142;
(19) the *Clostridium lavalense* comprises a 16S rDNA sequence that is at least 97% identical to the sequence set forth in SEQ ID NO: 184;
(20) the *Clostridium innocuum* comprises a 16S rDNA sequence that is at least 97% identical to the sequence set forth in any one of SEQ ID NO: 179, SEQ ID NO: 180, SEQ ID NO: 181, SEQ ID NO: 182, or a combination thereof;
(21) the *Clostridium asparagiforme* comprises a 16S rDNA sequence that is at least 97% identical to the sequence set forth in SEQ ID NO: 143;
(22) the *Clostridium spiroforme* comprises a 16S rDNA sequence that is at least 97% identical to the sequence set forth in SEQ ID NO: 194;
(23) the *Clostridium hylemonae* comprises a 16S rDNA sequence that is at least 97% identical to the sequence set forth in any one of SEQ ID NO: 176, SEQ ID NO: 177, SEQ ID NO: 178, or a combination thereof;
(24) the *Clostridium sordellii* comprises a 16S rDNA sequence that is at least 97% identical to the sequence set forth in SEQ ID NO: 190;
(25) the *Clostridium* sp_YIT_12069 comprises a 16S rDNA sequence that is at least 97% identical to the sequence set forth in SEQ ID NO: 197;
(26) the *Clostridium paraputrificum* comprises a 16S rDNA sequence that is at least 97% identical to the sequence set forth in SEQ ID NO: 188;
(27) the *Clostridium glycolicum* comprises a 16S rDNA sequence that is at least 97% identical to the sequence set forth in SEQ ID NO: 173;
(28) the *Clostridium ghonii* comprises a 16S rDNA sequence that is at least 97% identical to the sequence set forth in SEQ ID NO: 172;
(29) the *Clostridium viride* comprises a 16S rDNA sequence that is at least 97% identical to the sequence set forth in SEQ ID NO: 200;
(30) the *Clostridium* sp_HGF2 comprises a 16S rDNA sequence that is at least 97% identical to the sequence set forth in SEQ ID NO: 193;
(31) the *Clostridium symbiosum* comprises a 16S rDNA sequence that is at least 97% identical to the sequence set forth in SEQ ID NO: 198, SEQ ID NO: 199, or both;
(32) the *Clostridium scindens* comprises a 16S rDNA sequence that is at least 97% identical to the sequence set forth in SEQ ID NO: 189;
(33) the *Clostridium disporicum* comprises a 16S rDNA sequence that is at least 97% identical to the sequence set forth in SEQ ID NO: 170, SEQ ID NO: 171, or both;
(34) the *Clostridium butyricum* comprises a 16S rDNA sequence that is at least 97% identical to the sequence set forth in SEQ ID NO: 150, SEQ ID NO: 151, or both;
(35) the *Clostridium orbiscindens* comprises a 16S rDNA sequence that is at least 97% identical to the sequence set forth in SEQ ID NO: 186;
(36) the *Clostridium bolteae* comprises a 16S rDNA sequence that is at least 97% identical to the sequence set forth in SEQ ID NO: 149;
(37) the *Clostridium* sp_7_2_43FAA comprises a 16S rDNA sequence that is at least 97% identical to the sequence set forth in SEQ ID NO: 191;
(38) the *Collinsella aerofaciens* comprises a 16S rDNA sequence that is at least 97% identical to the sequence set forth in SEQ ID NO: 201;
(39) the *Coprobacillus* sp_D7 comprises a 16S rDNA sequence that is at least 97% identical to the sequence set forth in SEQ ID NO: 206;
(40) the *Coprococcus comes* comprises a 16S rDNA sequence that is at least 97% identical to the sequence set forth in SEQ ID NO: 207;
(41) the *Coprococcus eutactus* comprises a 16S rDNA sequence that is at least 97% identical to the sequence set forth in SEQ ID NO: 208;
(42) the *Dorea longicatena* comprises a 16S rDNA sequence that is at least 97% identical to the sequence set forth in SEQ ID NO: 211;
(43) the *Dorea formicigenerans* comprises a 16S rDNA sequence that is at least 97% identical to the sequence set forth in SEQ ID NO: 210;
(44) the *Erysipelotrichaceae bacterium*_3_1_53 comprises a 16S rDNA sequence that is at least 97% identical to the sequence set forth in SEQ ID NO: 214;
(45) the *Eubacterium* sp_3_1_31 comprises a 16S rDNA sequence that is at least 97% identical to the sequence set forth in SEQ ID NO: 227;
(46) the *Eubacterium* sp_WAL_14571 comprises a 16S rDNA sequence that is at least 97% identical to the sequence set forth in SEQ ID NO: 229;
(47) the *Eubacterium limosum* comprises a 16S rDNA sequence that is at least 97% identical to the sequence set forth in SEQ ID NO: 222;
(48) the *Eubacterium hallii* comprises a 16S rDNA sequence that is at least 97% identical to the sequence set forth in SEQ ID NO: 220, SEQ ID NO: 221, or both;
(49) the *Eubacterium rectale* comprises a 16S rDNA sequence that is at least 97% identical to the sequence set forth in any one of SEQ ID NO: 223, SEQ ID NO: 224, SEQ ID NO: 225, SEQ ID NO: 226, or a combination thereof;
(50) the *Eubacterium contortum* comprises a 16S rDNA sequence that is at least 97% identical to the sequence set forth in SEQ ID NO: 217;
(51) the *Lachnospiraceae bacterium*_2_1_58FAA comprises a 16S rDNA sequence that is at least 97% identical to the sequence set forth in SEQ ID NO: 244;
(52) the *Lachnospiraceae bacterium*_9_1_43BFAA comprises a 16S rDNA sequence that is at least 97% identical to the sequence set forth in SEQ ID NO: 250;
(53) the *Lachnospiraceae bacterium*_3_1_57FAA_CT1 comprises a 16S rDNA sequence that is at least 97% identical to the sequence set forth in SEQ ID NO: 245;
(54) the *Lachnospiraceae bacterium*_5_1_57FAA comprises a 16S rDNA sequence that is at least 97% identical to the sequence set forth in SEQ ID NO: 247;
(55) the *Lachnospiraceae bacterium_oral_taxon*_F15 comprises a 16S rDNA sequence that is at least 97% identical to the sequence set forth in SEQ ID NO: 251;
(56) the *Lactobacillus acidophilus* comprises a 16S rDNA sequence that is at least 97% identical to the sequence set forth in SEQ ID NO: 252, SEQ ID NO: 253, or both;
(57) the *Lactobacillus gasseri* comprises a 16S rDNA sequence that is at least 97% identical to the sequence set forth in any one of SEQ ID NO: 260, SEQ ID NO: 261, SEQ ID NO: 262, SEQ ID NO: 263, SEQ ID NO: 264, SEQ ID NO: 265, SEQ ID NO: 266, or a combination thereof;
(58) the *Parabacteroides distasonis* comprises a 16S rDNA sequence that is at least 97% identical to the sequence set forth in any one of SEQ ID NO: 272, SEQ ID NO: 273, SEQ ID NO: 274, SEQ ID NO: 274, SEQ ID NO: 275, SEQ ID NO: 276, SEQ ID NO: 277, SEQ ID NO: 278, or a combination thereof;

(59) the *Pseudoflavonifractor capillosus* comprises a 16S rDNA sequence that is at least 97% identical to the sequence set forth in SEQ ID NO: 292;

(60) the *Roseburia faecis* comprises a 16S rDNA sequence that is at least 97% identical to the sequence set forth in SEQ ID NO: 294;

(61) the *Ruminococcus obeum* comprises a 16S rDNA sequence that is at least 97% identical to the sequence set forth in any one of SEQ ID NO: 303, SEQ ID NO: 304, SEQ ID NO: 305, or a combination thereof;

(62) the *Ruminococcus bromii* comprises a 16S rDNA sequence that is at least 97% identical to the sequence set forth in SEQ ID NO: 299, SEQ ID NO: 300, or both;

(63) the *Ruminococcus lactaris* comprises a 16S rDNA sequence that is at least 97% identical to the sequence set forth in SEQ ID NO: 302; or

(64) the *Tannerella* sp_6_1_58FAA comprises a 16S rDNA sequence that is at least 97% identical to the sequence set forth in SEQ ID NO: 311.

12. The method of claim 1, wherein:

(1) the *Alistipes finegoldii* comprises the 16S rDNA sequence set forth in SEQ ID NO: 7;

(2) the *Bacteroides uniformis* comprises the 16S rDNA sequence set forth in SEQ ID NO: 45;

(3) the *Bacteroides vulgatus* comprises the 16S rDNA sequence set forth in any one of SEQ ID NO: 53, SEQ ID NO: 54, or SEQ ID NO: 55;

(4) the *Bacteroides* sp_3_1_19 comprises the 16S rDNA sequence set forth in SEQ ID NO: 33;

(5) the *Bacteroides intestinalis* comprises the 16S rDNA sequence set forth in SEQ ID NO: 22;

(6) the *Bacteroides* sp_20_3 comprises the 16S rDNA sequence set forth in SEQ ID NO: 20;

(7) the *Bacteroides caccae* comprises the 16S rDNA sequence set forth in SEQ ID NO: 9 or SEQ ID NO: 10;

(8) the *Bacteroides faecis* comprises the 16S rDNA sequence set forth in SEQ ID NO: 13;

(9) the *Bacteroides* sp_3_1_23 comprises the 16S rDNA sequence set forth in SEQ ID NO: 34;

(10) the *Bacteroides* sp_D20 comprises the 16S rDNA sequence set forth in SEQ ID NO: 39;

(11) the *Bacteroides eggerthii* comprises the 16S rDNA sequence set forth in SEQ ID NO: 12;

(12) the *Barnesiella intestinihominis* comprises the 16S rDNA sequence set forth in SEQ ID NO: 59;

(13) the *Bifidobacterium pseudocatenulatum* comprises the 16S rDNA sequence set forth in SEQ ID NO: 113 or SEQ ID NO: 114;

(14) the *Blautia schinkii* comprises the 16S rDNA sequence set forth in SEQ ID NO: 130;

(15) the *Blautia wexlerae* comprises the 16S rDNA sequence set forth in SEQ ID NO: 133;

(16) the *Blautia* sp_M25 comprises the 16S rDNA sequence set forth in SEQ ID NO: 131;

(17) the *Blautia producta* comprises the 16S rDNA sequence set forth in SEQ ID NO: 128 or SEQ ID NO: 129;

(18) the *Clostridiales* sp_SM4_1 comprises the 16S rDNA sequence set forth in SEQ ID NO: 142;

(19) the *Clostridium lavalense* comprises the 16S rDNA sequence set forth in SEQ ID NO: 184;

(20) the *Clostridium innocuum* comprises the 16S rDNA sequence set forth in SEQ ID NO: 179, SEQ ID NO: 180, SEQ ID NO: 181, or SEQ ID NO: 182;

(21) the *Clostridium asparagiforme* comprises the 16S rDNA sequence set forth in SEQ ID NO: 143;

(22) the *Clostridium spiroforme* comprises the 16S rDNA sequence set forth in SEQ ID NO: 194;

(23) the *Clostridium hylemonae* comprises the 16S rDNA sequence set forth in SEQ ID NO: 176, SEQ ID NO: 177, or SEQ ID NO: 178;

(24) the *Clostridium sordellii* comprises the 16S rDNA sequence set forth in SEQ ID NO: 190;

(25) the *Clostridium* sp_YIT_12069 comprises the 16S rDNA sequence set forth in SEQ ID NO: 197;

(26) the *Clostridium paraputrificum* comprises the 16S rDNA sequence set forth in SEQ ID NO: 188;

(27) the *Clostridium glycolicum* comprises the 16S rDNA sequence set forth in SEQ ID NO: 173;

(28) the *Clostridium ghonii* comprises the 16S rDNA sequence set forth in SEQ ID NO: 172;

(29) the *Clostridium viride* comprises the 16S rDNA sequence set forth in SEQ ID NO: 200;

(30) the *Clostridium* sp_HGF2 comprises the 16S rDNA sequence set forth in SEQ ID NO: 193;

(31) the *Clostridium symbiosum* comprises the 16S rDNA sequence set forth in SEQ ID NO: 198 or SEQ ID NO: 199;

(32) the *Clostridium scindens* comprises the 16S rDNA sequence set forth in SEQ ID NO: 189;

(33) the *Clostridium disporicum* comprises the 16S rDNA sequence set forth in SEQ ID NO: 170 or SEQ ID NO: 171;

(34) the *Clostridium butyricum* comprises the 16S rDNA sequence set forth in SEQ ID NO: 150 or SEQ ID NO: 151;

(35) the *Clostridium orbiscindens* comprises the 16S rDNA sequence set forth in SEQ ID NO: 186;

(36) the *Clostridium bolteae* comprises the 16S rDNA sequence set forth in SEQ ID NO: 149;

(37) the *Clostridium* sp_7_2_43FAA comprises the 16S rDNA sequence set forth in SEQ ID NO: 191;

(38) the *Collinsella aerofaciens* comprises the 16S rDNA sequence set forth in SEQ ID NO: 201;

(39) the *Coprobacillus* sp_D7 comprises the 16S rDNA sequence set forth in SEQ ID NO: 206;

(40) the *Coprococcus comes* comprises the 16S rDNA sequence set forth in SEQ ID NO: 207;

(41) the *Coprococcus eutactus* comprises the 16S rDNA sequence set forth in SEQ ID NO: 208;

(42) the *Dorea longicatena* comprises the 16S rDNA sequence set forth in SEQ ID NO: 211;

(43) the *Dorea formicigenerans* comprises the 16S rDNA sequence set forth in SEQ ID NO: 210;

(44) the *Erysipelotrichaceae bacterium*_3_1_53 comprises the 16S rDNA sequence set forth in SEQ ID NO: 214;

(45) the *Eubacterium* sp_3_1_31 comprises the 16S rDNA sequence set forth in SEQ ID NO: 227;

(46) the *Eubacterium* sp_WAL_14571 comprises the 16S rDNA sequence set forth in SEQ ID NO: 229;

(47) the *Eubacterium limosum* comprises the 16S rDNA sequence set forth in SEQ ID NO: 222;

(48) the *Eubacterium hallii* comprises the 16S rDNA sequence set forth in SEQ ID NO: 220 or SEQ ID NO: 221;

(49) the *Eubacterium rectale* comprises the 16S rDNA sequence set forth in SEQ ID NO: 223, SEQ ID NO: 224, SEQ ID NO: 225, or SEQ ID NO: 226;

(50) the *Eubacterium contortum* comprises the 16S rDNA sequence set forth in SEQ ID NO: 217;

(51) the *Lachnospiraceae bacterium_2_1_58FAA* comprises the 16S rDNA sequence set forth in SEQ ID NO: 244;
(52) the *Lachnospiraceae bacterium_9_1_43BFAA* comprises the 16S rDNA sequence set forth in SEQ ID NO: 250;
(53) the *Lachnospiraceae bacterium_3_1_57FAA_CT1* comprises the 16S rDNA sequence set forth in SEQ ID NO: 245;
(54) the *Lachnospiraceae bacterium_5_1_57FAA* comprises the 16S rDNA sequence set forth in SEQ ID NO: 247;
(55) the *Lachnospiraceae bacterium_oral_taxon_F15* comprises the 16S rDNA sequence set forth in SEQ ID NO: 251;
(56) the *Lactobacillus acidophilus* comprises the 16S rDNA sequence set forth in SEQ ID NO: 252 or SEQ ID NO: 253;
(57) the *Lactobacillus gasseri* comprises the 16S rDNA sequence set forth in SEQ ID NO: 260, SEQ ID NO: 261, SEQ ID NO: 262, SEQ ID NO: 263, SEQ ID NO: 264, SEQ ID NO: 265, or SEQ ID NO: 266;
(58) the *Parabacteroides distasonis* comprises the 16S rDNA sequence set forth in SEQ ID NO: 272, SEQ ID NO: 273, SEQ ID NO: 274, SEQ ID NO: 274, SEQ ID NO: 275, SEQ ID NO: 276, SEQ ID NO: 277, or SEQ ID NO: 278;
(59) the *Pseudoflavonifractor capillosus* comprises the 16S rDNA sequence set forth in SEQ ID NO: 292;
(60) the *Roseburia faecis* comprises the 16S rDNA sequence set forth in SEQ ID NO: 294;
(61) the *Ruminococcus obeum* comprises the 16S rDNA sequence set forth in SEQ ID NO: 303, SEQ ID NO: 304, or SEQ ID NO: 305;
(62) the *Ruminococcus bromii* comprises the 16S rDNA sequence set forth in SEQ ID NO: 299 or SEQ ID NO: 300;
(63) the *Ruminococcus lactaris* comprises the 16S rDNA sequence set forth in SEQ ID NO: 302; or
(64) the *Tannerella sp_6_1_58FAA* comprises the 16S rDNA sequence set forth in SEQ ID NO: 311.

13. The method of claim 7, wherein:
(1) the *Alistipes finegoldii* comprises the 16S rDNA sequence set forth in SEQ ID NO: 7;
(2) the *Bacteroides uniformis* comprises the 16S rDNA sequence set forth in SEQ ID NO: 45;
(3) the *Bacteroides vulgatus* comprises the 16S rDNA sequence set forth in any one of SEQ ID NO: 53, SEQ ID NO: 54, or SEQ ID NO: 55;
(4) the *Bacteroides sp_3_1_19* comprises the 16S rDNA sequence set forth in SEQ ID NO: 33;
(5) the *Bacteroides intestinalis* comprises the 16S rDNA sequence set forth in SEQ ID NO: 22;
(6) the *Bacteroides sp_20_3* comprises the 16S rDNA sequence set forth in SEQ ID NO: 20;
(7) the *Bacteroides caccae* comprises the 16S rDNA sequence set forth in SEQ ID NO: 9 or SEQ ID NO: 10;
(8) the *Bacteroides faecis* comprises the 16S rDNA sequence set forth in SEQ ID NO: 13;
(9) the *Bacteroides sp_3_1_23* comprises the 16S rDNA sequence set forth in SEQ ID NO: 34;
(10) the *Bacteroides sp_D20* comprises the 16S rDNA sequence set forth in SEQ ID NO: 39;
(11) the *Bacteroides eggerthii* comprises the 16S rDNA sequence set forth in SEQ ID NO: 12;
(12) the *Barnesiella intestinihominis* comprises the 16S rDNA sequence set forth in SEQ ID NO: 59;
(13) the *Bifidobacterium pseudocatenulatum* comprises the 16S rDNA sequence set forth in SEQ ID NO: 113 or SEQ ID NO: 114;
(14) the *Blautia schinkii* comprises the 16S rDNA sequence set forth in SEQ ID NO: 130;
(15) the *Blautia wexlerae* comprises the 16S rDNA sequence set forth in SEQ ID NO: 133;
(16) the *Blautia sp_M25* comprises the 16S rDNA sequence set forth in SEQ ID NO: 131;
(17) the *Blautia producta* comprises the 16S rDNA sequence set forth in SEQ ID NO: 128 or SEQ ID NO: 129;
(18) the *Clostridiales sp_SM4_1* comprises the 16S rDNA sequence set forth in SEQ ID NO: 142;
(19) the *Clostridium lavalense* comprises the 16S rDNA sequence set forth in SEQ ID NO: 184;
(20) the *Clostridium innocuum* comprises the 16S rDNA sequence set forth in SEQ ID NO: 179, SEQ ID NO: 180, SEQ ID NO: 181, or SEQ ID NO: 182;
(21) the *Clostridium asparagiforme* comprises the 16S rDNA sequence set forth in SEQ ID NO: 143;
(22) the *Clostridium spiroforme* comprises the 16S rDNA sequence set forth in SEQ ID NO: 194;
(23) the *Clostridium hylemonae* comprises the 16S rDNA sequence set forth in SEQ ID NO: 176, SEQ ID NO: 177, or SEQ ID NO: 178;
(24) the *Clostridium sordellii* comprises the 16S rDNA sequence set forth in SEQ ID NO: 190;
(25) the *Clostridium sp_YIT_12069* comprises the 16S rDNA sequence set forth in SEQ ID NO: 197;
(26) the *Clostridium paraputrificum* comprises the 16S rDNA sequence set forth in SEQ ID NO: 188;
(27) the *Clostridium glycolicum* comprises the 16S rDNA sequence set forth in SEQ ID NO: 173;
(28) the *Clostridium ghonii* comprises the 16S rDNA sequence set forth in SEQ ID NO: 172;
(29) the *Clostridium viride* comprises the 16S rDNA sequence set forth in SEQ ID NO: 200;
(30) the *Clostridium sp_HGF2* comprises the 16S rDNA sequence set forth in SEQ ID NO: 193;
(31) the *Clostridium symbiosum* comprises the 16S rDNA sequence set forth in SEQ ID NO: 198 or SEQ ID NO: 199;
(32) the *Clostridium scindens* comprises the 16S rDNA sequence set forth in SEQ ID NO: 189;
(33) the *Clostridium disporicum* comprises the 16S rDNA sequence set forth in SEQ ID NO: 170 or SEQ ID NO: 171;
(34) the *Clostridium butyricum* comprises the 16S rDNA sequence set forth in SEQ ID NO: 150 or SEQ ID NO: 151;
(35) the *Clostridium orbiscindens* comprises the 16S rDNA sequence set forth in SEQ ID NO: 186;
(36) the *Clostridium bolteae* comprises the 16S rDNA sequence set forth in SEQ ID NO: 149;
(37) the *Clostridium sp_7_2_43FAA* comprises the 16S rDNA sequence set forth in SEQ ID NO: 191;
(38) the *Collinsella aerofaciens* comprises the 16S rDNA sequence set forth in SEQ ID NO: 201;
(39) the *Coprobacillus sp_D7* comprises the 16S rDNA sequence set forth in SEQ ID NO: 206;
(40) the *Coprococcus comes* comprises the 16S rDNA sequence set forth in SEQ ID NO: 207;
(41) the *Coprococcus eutactus* comprises the 16S rDNA sequence set forth in SEQ ID NO: 208;
(42) the *Dorea longicatena* comprises the 16S rDNA sequence set forth in SEQ ID NO: 211;

(43) the *Dorea formicigenerans* comprises the 16S rDNA sequence set forth in SEQ ID NO: 210;
(44) the *Erysipelotrichaceae bacterium_3_1_53* comprises the 16S rDNA sequence set forth in SEQ ID NO: 214;
(45) the *Eubacterium sp_3_1_31* comprises the 16S rDNA sequence set forth in SEQ ID NO: 227;
(46) the *Eubacterium sp_WAL_14571* comprises the 16S rDNA sequence set forth in SEQ ID NO: 229;
(47) the *Eubacterium limosum* comprises the 16S rDNA sequence set forth in SEQ ID NO: 222;
(48) the *Eubacterium hallii* comprises the 16S rDNA sequence set forth in SEQ ID NO: 220 or SEQ ID NO: 221;
(49) the *Eubacterium rectale* comprises the 16S rDNA sequence set forth in SEQ ID NO: 223, SEQ ID NO: 224, SEQ ID NO: 225, or SEQ ID NO: 226;
(50) the *Eubacterium contortum* comprises the 16S rDNA sequence set forth in SEQ ID NO: 217;
(51) the *Lachnospiraceae bacterium_2_1_58FAA* comprises the 16S rDNA sequence set forth in SEQ ID NO: 244;
(52) the *Lachnospiraceae bacterium_9_1_43BFAA* comprises the 16S rDNA sequence set forth in SEQ ID NO: 250;
(53) the *Lachnospiraceae bacterium_3_1_57FAA_CT1* comprises the 16S rDNA sequence set forth in SEQ ID NO: 245;
(54) the *Lachnospiraceae bacterium_5_1_57FAA* comprises the 16S rDNA sequence set forth in SEQ ID NO: 247;
(55) the *Lachnospiraceae bacterium_oral_taxon_F15* comprises the 16S rDNA sequence set forth in SEQ ID NO: 251;
(56) the *Lactobacillus acidophilus* comprises the 16S rDNA sequence set forth in SEQ ID NO: 252 or SEQ ID NO: 253;
(57) the *Lactobacillus gasseri* comprises the 16S rDNA sequence set forth in SEQ ID NO: 260, SEQ ID NO: 261, SEQ ID NO: 262, SEQ ID NO: 263, SEQ ID NO: 264, SEQ ID NO: 265, or SEQ ID NO: 266;
(58) the *Parabacteroides distasonis* comprises the 16S rDNA sequence set forth in SEQ ID NO: 272, SEQ ID NO: 273, SEQ ID NO: 274, SEQ ID NO: 274, SEQ ID NO: 275, SEQ ID NO: 276, SEQ ID NO: 277, or SEQ ID NO: 278;
(59) the *Pseudoflavonifractor capillosus* comprises the 16S rDNA sequence set forth in SEQ ID NO: 292;
(60) the *Roseburia faecis* comprises the 16S rDNA sequence set forth in SEQ ID NO: 294;
(61) the *Ruminococcus obeum* comprises the 16S rDNA sequence set forth in SEQ ID NO: 303, SEQ ID NO: 304, or SEQ ID NO: 305;
(62) the *Ruminococcus bromii* comprises the 16S rDNA sequence set forth in SEQ ID NO: 299 or SEQ ID NO: 300;
(63) the *Ruminococcus lactaris* comprises the 16S rDNA sequence set forth in SEQ ID NO: 302; or
(64) the *Tannerella sp_6_1_58FAA* comprises the 16S rDNA sequence set forth in SEQ ID NO: 311.

14. The method of claim 1, wherein:
(1) the *Alistipes finegoldii* comprises a 16S rDNA sequence that is at least 98% identical to the sequence set forth in SEQ ID NO: 7;
(2) the *Bacteroides uniformis* comprises a 16S rDNA sequence that is at least 98% identical to the sequence set forth in SEQ ID NO: 45;
(3) the *Bacteroides vulgatus* comprises a 16S rDNA sequence that is at least 98% identical to the sequence set forth in any one of SEQ ID NO: 53, SEQ ID NO: 54, SEQ ID NO: 55, or a combination thereof;
(4) the *Bacteroides sp_3_1_19* comprises a 16S rDNA sequence that is at least 98% identical to the sequence set forth in SEQ ID NO: 33;
(5) the *Bacteroides intestinalis* comprises a 16S rDNA sequence that is at least 98% identical to the sequence set forth in SEQ ID NO: 22;
(6) the *Bacteroides sp_20_3* comprises a 16S rDNA sequence that is at least 98% identical to the sequence set forth in SEQ ID NO: 20;
(7) the *Bacteroides caccae* comprises a 16S rDNA sequence that is at least 98% identical to the sequence set forth in SEQ ID NO: 9, SEQ ID NO: 10, or both;
(8) the *Bacteroides faecis* comprises a 16S rDNA sequence that is at least 98% identical to the sequence set forth in SEQ ID NO: 13;
(9) the *Bacteroides sp_3_1_23* comprises a 16S rDNA sequence that is at least 98% identical to the sequence set forth in SEQ ID NO: 34;
(10) the *Bacteroides sp_D20* comprises a 16S rDNA sequence that is at least 98% identical to the sequence set forth in SEQ ID NO: 39;
(11) the *Bacteroides eggerthii* comprises a 16S rDNA sequence that is at least 98% identical to the sequence set forth in SEQ ID NO: 12;
(12) the *Barnesiella intestinihominis* comprises a 16S rDNA sequence that is at least 98% identical to the sequence set forth in SEQ ID NO: 59;
(13) the *Bifidobacterium pseudocatenulatum* comprises a 16S rDNA sequence that is at least 98% identical to the sequence set forth in SEQ ID NO: 113, SEQ ID NO: 114, or both;
(14) the *Blautia schinkii* comprises a 16S rDNA sequence that is at least 98% identical to the sequence set forth in SEQ ID NO: 130;
(15) the *Blautia wexlerae* comprises a 16S rDNA sequence that is at least 98% identical to the sequence set forth in SEQ ID NO: 133;
(16) the *Blautia sp_M25* comprises a 16S rDNA sequence that is at least 98% identical to the sequence set forth in SEQ ID NO: 131;
(17) the *Blautia producta* comprises a 16S rDNA sequence that is at least 98% identical to the sequence set forth in SEQ ID NO: 128, SEQ ID NO: 129, or both;
(18) the *Clostridiales sp_SM4_1* comprises a 16S rDNA sequence that is at least 98% identical to the sequence set forth in SEQ ID NO: 142;
(19) the *Clostridium lavalense* comprises a 16S rDNA sequence that is at least 98% identical to the sequence set forth in SEQ ID NO: 184;
(20) the *Clostridium innocuum* comprises a 16S rDNA sequence that is at least 98% identical to the sequence set forth in any one of SEQ ID NO: 179, SEQ ID NO: 180, SEQ ID NO: 181, SEQ ID NO: 182, or a combination thereof;
(21) the *Clostridium asparagiforme* comprises a 16S rDNA sequence that is at least 98% identical to the sequence set forth in SEQ ID NO: 143;
(22) the *Clostridium spiroforme* comprises a 16S rDNA sequence that is at least 98% identical to the sequence set forth in SEQ ID NO: 194;
(23) the *Clostridium hylemonae* comprises a 16S rDNA sequence that is at least 98% identical to the sequence set forth in any one of SEQ ID NO: 176, SEQ ID NO: 177, SEQ ID NO: 178, or a combination thereof;

(24) the *Clostridium sordellii* comprises a 16S rDNA sequence that is at least 98% identical to the sequence set forth in SEQ ID NO: 190;

(25) the *Clostridium* sp_YIT_12069 comprises a 16S rDNA sequence that is at least 98% identical to the sequence set forth in SEQ ID NO: 197;

(26) the *Clostridium paraputrificum* comprises a 16S rDNA sequence that is at least 98% identical to the sequence set forth in SEQ ID NO: 188;

(27) the *Clostridium glycolicum* comprises a 16S rDNA sequence that is at least 98% identical to the sequence set forth in SEQ ID NO: 173;

(28) the *Clostridium ghonii* comprises a 16S rDNA sequence that is at least 98% identical to the sequence set forth in SEQ ID NO: 172;

(29) the *Clostridium viride* comprises a 16S rDNA sequence that is at least 98% identical to the sequence set forth in SEQ ID NO: 200;

(30) the *Clostridium* sp_HGF2 comprises a 16S rDNA sequence that is at least 98% identical to the sequence set forth in SEQ ID NO: 193;

(31) the *Clostridium symbiosum* comprises a 16S rDNA sequence that is at least 98% identical to the sequence set forth in SEQ ID NO: 198, SEQ ID NO: 199, or both;

(32) the *Clostridium scindens* comprises a 16S rDNA sequence that is at least 98% identical to the sequence set forth in SEQ ID NO: 189;

(33) the *Clostridium disporicum* comprises a 16S rDNA sequence that is at least 98% identical to the sequence set forth in SEQ ID NO: 170, SEQ ID NO: 171, or both;

(34) the *Clostridium butyricum* comprises a 16S rDNA sequence that is at least 98% identical to the sequence set forth in SEQ ID NO: 150, SEQ ID NO: 151, or both;

(35) the *Clostridium orbiscindens* comprises a 16S rDNA sequence that is at least 98% identical to the sequence set forth in SEQ ID NO: 186;

(36) the *Clostridium bolteae* comprises a 16S rDNA sequence that is at least 98% identical to the sequence set forth in SEQ ID NO: 149;

(37) the *Clostridium* sp_7_2_43FAA comprises a 16S rDNA sequence that is at least 98% identical to the sequence set forth in SEQ ID NO: 191;

(38) the *Collinsella aerofaciens* comprises a 16S rDNA sequence that is at least 98% identical to the sequence set forth in SEQ ID NO: 201;

(39) the *Coprobacillus* sp_D7 comprises a 16S rDNA sequence that is at least 98% identical to the sequence set forth in SEQ ID NO: 206;

(40) the *Coprococcus comes* comprises a 16S rDNA sequence that is at least 98% identical to the sequence set forth in SEQ ID NO: 207;

(41) the *Coprococcus eutactus* comprises a 16S rDNA sequence that is at least 98% identical to the sequence set forth in SEQ ID NO: 208;

(42) the *Dorea longicatena* comprises a 16S rDNA sequence that is at least 98% identical to the sequence set forth in SEQ ID NO: 211;

(43) the *Dorea formicigenerans* comprises a 16S rDNA sequence that is at least 98% identical to the sequence set forth in SEQ ID NO: 210;

(44) the *Erysipelotrichaceae bacterium*_3_1_53 comprises a 16S rDNA sequence that is at least 98% identical to the sequence set forth in SEQ ID NO: 214;

(45) the *Eubacterium* sp_3_1_31 comprises a 16S rDNA sequence that is at least 98% identical to the sequence set forth in SEQ ID NO: 227;

(46) the *Eubacterium* sp_WAL_14571 comprises a 16S rDNA sequence that is at least 98% identical to the sequence set forth in SEQ ID NO: 229;

(47) the *Eubacterium limosum* comprises a 16S rDNA sequence that is at least 98% identical to the sequence set forth in SEQ ID NO: 222;

(48) the *Eubacterium hallii* comprises a 16S rDNA sequence that is at least 98% identical to the sequence set forth in SEQ ID NO: 220, SEQ ID NO: 221, or both;

(49) the *Eubacterium rectale* comprises a 16S rDNA sequence that is at least 98% identical to the sequence set forth in any one of SEQ ID NO: 223, SEQ ID NO: 224, SEQ ID NO: 225, SEQ ID NO: 226, or a combination thereof;

(50) the *Eubacterium contortum* comprises a 16S rDNA sequence that is at least 98% identical to the sequence set forth in SEQ ID NO: 217;

(51) the *Lachnospiraceae bacterium*_2_1_58FAA comprises a 16S rDNA sequence that is at least 98% identical to the sequence set forth in SEQ ID NO: 244;

(52) the *Lachnospiraceae bacterium*_9_1_43BFAA comprises a 16S rDNA sequence that is at least 98% identical to the sequence set forth in SEQ ID NO: 250;

(53) the *Lachnospiraceae bacterium*_3_1_57FAA_CT1 comprises a 16S rDNA sequence that is at least 98% identical to the sequence set forth in SEQ ID NO: 245;

(54) the *Lachnospiraceae bacterium*_5_1_57FAA comprises a 16S rDNA sequence that is at least 98% identical to the sequence set forth in SEQ ID NO: 247;

(55) the *Lachnospiraceae bacterium*_oral_taxon_F15 comprises a 16S rDNA sequence that is at least 98% identical to the sequence set forth in SEQ ID NO: 251;

(56) the *Lactobacillus acidophilus* comprises a 16S rDNA sequence that is at least 98% identical to the sequence set forth in SEQ ID NO: 252, SEQ ID NO: 253, or both;

(57) the *Lactobacillus gasseri* comprises a 16S rDNA sequence that is at least 98% identical to the sequence set forth in any one of SEQ ID NO: 260, SEQ ID NO: 261, SEQ ID NO: 262, SEQ ID NO: 263, SEQ ID NO: 264, SEQ ID NO: 265, SEQ ID NO: 266, or a combination thereof;

(58) the *Parabacteroides distasonis* comprises a 16S rDNA sequence that is at least 98% identical to the sequence set forth in any one of SEQ ID NO: 272, SEQ ID NO: 273, SEQ ID NO: 274, SEQ ID NO: 274, SEQ ID NO: 275, SEQ ID NO: 276, SEQ ID NO: 277, SEQ ID NO: 278, or a combination thereof;

(59) the *Pseudoflavonifractor capillosus* comprises a 16S rDNA sequence that is at least 98% identical to the sequence set forth in SEQ ID NO: 292;

(60) the *Roseburia faecis* comprises a 16S rDNA sequence that is at least 98% identical to the sequence set forth in SEQ ID NO: 294;

(61) the *Ruminococcus obeum* comprises a 16S rDNA sequence that is at least 98% identical to the sequence set forth in any one of SEQ ID NO: 303, SEQ ID NO: 304, SEQ ID NO: 305, or a combination thereof;

(62) the *Ruminococcus bromii* comprises a 16S rDNA sequence that is at least 98% identical to the sequence set forth in SEQ ID NO: 299, SEQ ID NO: 300, or both;

(63) the *Ruminococcus lactaris* comprises a 16S rDNA sequence that is at least 98% identical to the sequence set forth in SEQ ID NO: 302; or

(64) the *Tannerella* sp_6_1_58FAA comprises a 16S rDNA sequence that is at least 98% identical to the sequence set forth in SEQ ID NO: 311.

15. The method of claim 1, wherein:
(1) the *Alistipes finegoldii* comprises a 16S rDNA sequence that is at least 99% identical to the sequence set forth in SEQ ID NO: 7;
(2) the *Bacteroides uniformis* comprises a 16S rDNA sequence that is at least 99% identical to the sequence set forth in SEQ ID NO: 45;
(3) the *Bacteroides vulgatus* comprises a 16S rDNA sequence that is at least 99% identical to the sequence set forth in any one of SEQ ID NO: 53, SEQ ID NO: 54, SEQ ID NO: 55, or a combination thereof;
(4) the *Bacteroides* sp_3_1_19 comprises a 16S rDNA sequence that is at least 99% identical to the sequence set forth in SEQ ID NO: 33;
(5) the *Bacteroides intestinalis* comprises a 16S rDNA sequence that is at least 99% identical to the sequence set forth in SEQ ID NO: 22;
(6) the *Bacteroides* sp_20_3 comprises a 16S rDNA sequence that is at least 99% identical to the sequence set forth in SEQ ID NO: 20;
(7) the *Bacteroides caccae* comprises a 16S rDNA sequence that is at least 99% identical to the sequence set forth in SEQ ID NO: 9, SEQ ID NO: 10, or both;
(8) the *Bacteroides faecis* comprises a 16S rDNA sequence that is at least 99% identical to the sequence set forth in SEQ ID NO: 13;
(9) the *Bacteroides* sp_3_1_23 comprises a 16S rDNA sequence that is at least 99% identical to the sequence set forth in SEQ ID NO: 34;
(10) the *Bacteroides* sp_D20 comprises a 16S rDNA sequence that is at least 99% identical to the sequence set forth in SEQ ID NO: 39;
(11) the *Bacteroides eggerthii* comprises a 16S rDNA sequence that is at least 99% identical to the sequence set forth in SEQ ID NO: 12;
(12) the *Barnesiella intestinihominis* comprises a 16S rDNA sequence that is at least 99% identical to the sequence set forth in SEQ ID NO: 59;
(13) the *Bifidobacterium pseudocatenulatum* comprises a 16S rDNA sequence that is at least 99% identical to the sequence set forth in SEQ ID NO: 113, SEQ ID NO: 114, or both;
(14) the *Blautia schinkii* comprises a 16S rDNA sequence that is at least 99% identical to the sequence set forth in SEQ ID NO: 130;
(15) the *Blautia wexlerae* comprises a 16S rDNA sequence that is at least 99% identical to the sequence set forth in SEQ ID NO: 133;
(16) the *Blautia* sp_M25 comprises a 16S rDNA sequence that is at least 99% identical to the sequence set forth in SEQ ID NO: 131;
(17) the *Blautia producta* comprises a 16S rDNA sequence that is at least 99% identical to the sequence set forth in SEQ ID NO: 128, SEQ ID NO: 129, or both;
(18) the *Clostridiales* sp_SM4_1 comprises a 16S rDNA sequence that is at least 99% identical to the sequence set forth in SEQ ID NO: 142;
(19) the *Clostridium lavalense* comprises a 16S rDNA sequence that is at least 99% identical to the sequence set forth in SEQ ID NO: 184;
(20) the *Clostridium innocuum* comprises a 16S rDNA sequence that is at least 99% identical to the sequence set forth in any one of SEQ ID NO: 179, SEQ ID NO: 180, SEQ ID NO: 181, SEQ ID NO: 182, or a combination thereof;
(21) the *Clostridium asparagiforme* comprises a 16S rDNA sequence that is at least 99% identical to the sequence set forth in SEQ ID NO: 143;
(22) the *Clostridium spiroforme* comprises a 16S rDNA sequence that is at least 99% identical to the sequence set forth in SEQ ID NO: 194;
(23) the *Clostridium hylemonae* comprises a 16S rDNA sequence that is at least 99% identical to the sequence set forth in any one of SEQ ID NO: 176, SEQ ID NO: 177, SEQ ID NO: 178, or a combination thereof;
(24) the *Clostridium sordellii* comprises a 16S rDNA sequence that is at least 99% identical to the sequence set forth in SEQ ID NO: 190;
(25) the *Clostridium* sp_YIT_12069 comprises a 16S rDNA sequence that is at least 99% identical to the sequence set forth in SEQ ID NO: 197;
(26) the *Clostridium paraputrificum* comprises a 16S rDNA sequence that is at least 99% identical to the sequence set forth in SEQ ID NO: 188;
(27) the *Clostridium glycolicum* comprises a 16S rDNA sequence that is at least 99% identical to the sequence set forth in SEQ ID NO: 173;
(28) the *Clostridium ghonii* comprises a 16S rDNA sequence that is at least 99% identical to the sequence set forth in SEQ ID NO: 172;
(29) the *Clostridium viride* comprises a 16S rDNA sequence that is at least 99% identical to the sequence set forth in SEQ ID NO: 200;
(30) the *Clostridium* sp_HGF2 comprises a 16S rDNA sequence that is at least 99% identical to the sequence set forth in SEQ ID NO: 193;
(31) the *Clostridium symbiosum* comprises a 16S rDNA sequence that is at least 99% identical to the sequence set forth in SEQ ID NO: 198, SEQ ID NO: 199, or both;
(32) the *Clostridium scindens* comprises a 16S rDNA sequence that is at least 99% identical to the sequence set forth in SEQ ID NO: 189;
(33) the *Clostridium disporicum* comprises a 16S rDNA sequence that is at least 99% identical to the sequence set forth in SEQ ID NO: 170, SEQ ID NO: 171, or both;
(34) the *Clostridium butyricum* comprises a 16S rDNA sequence that is at least 99% identical to the sequence set forth in SEQ ID NO: 150, SEQ ID NO: 151, or both;
(35) the *Clostridium orbiscindens* comprises a 16S rDNA sequence that is at least 99% identical to the sequence set forth in SEQ ID NO: 186;
(36) the *Clostridium bolteae* comprises a 16S rDNA sequence that is at least 99% identical to the sequence set forth in SEQ ID NO: 149;
(37) the *Clostridium* sp_7_2_43FAA comprises a 16S rDNA sequence that is at least 99% identical to the sequence set forth in SEQ ID NO: 191;
(38) the *Collinsella aerofaciens* comprises a 16S rDNA sequence that is at least 99% identical to the sequence set forth in SEQ ID NO: 201;
(39) the *Coprobacillus* sp_D7 comprises a 16S rDNA sequence that is at least 99% identical to the sequence set forth in SEQ ID NO: 206;
(40) the *Coprococcus comes* comprises a 16S rDNA sequence that is at least 99% identical to the sequence set forth in SEQ ID NO: 207;
(41) the *Coprococcus eutactus* comprises a 16S rDNA sequence that is at least 99% identical to the sequence set forth in SEQ ID NO: 208;

(42) the *Dorea longicatena* comprises a 16S rDNA sequence that is at least 99% identical to the sequence set forth in SEQ ID NO: 211;
(43) the *Dorea formicigenerans* comprises a 16S rDNA sequence that is at least 99% identical to the sequence set forth in SEQ ID NO: 210;
(44) the *Erysipelotrichaceae bacterium*_3_1_53 comprises a 16S rDNA sequence that is at least 99% identical to the sequence set forth in SEQ ID NO: 214;
(45) the *Eubacterium* sp_3_1_31 comprises a 16S rDNA sequence that is at least 99% identical to the sequence set forth in SEQ ID NO: 227;
(46) the *Eubacterium* sp_WAL_14571 comprises a 16S rDNA sequence that is at least 99% identical to the sequence set forth in SEQ ID NO: 229;
(47) the *Eubacterium limosum* comprises a 16S rDNA sequence that is at least 99% identical to the sequence set forth in SEQ ID NO: 222;
(48) the *Eubacterium hallii* comprises a 16S rDNA sequence that is at least 99% identical to the sequence set forth in SEQ ID NO: 220, SEQ ID NO: 221, or both;
(49) the *Eubacterium rectale* comprises a 16S rDNA sequence that is at least 99% identical to the sequence set forth in any one of SEQ ID NO: 223, SEQ ID NO: 224, SEQ ID NO: 225, SEQ ID NO: 226, or a combination thereof;
(50) the *Eubacterium contortum* comprises a 16S rDNA sequence that is at least 99% identical to the sequence set forth in SEQ ID NO: 217;
(51) the *Lachnospiraceae bacterium*_2_1_58FAA comprises a 16S rDNA sequence that is at least 99% identical to the sequence set forth in SEQ ID NO: 244;
(52) the *Lachnospiraceae bacterium*_9_1_43BFAA comprises a 16S rDNA sequence that is at least 99% identical to the sequence set forth in SEQ ID NO: 250;
(53) the *Lachnospiraceae bacterium*_3_1_57FAA_CT1 comprises a 16S rDNA sequence that is at least 99% identical to the sequence set forth in SEQ ID NO: 245;
(54) the *Lachnospiraceae bacterium*_5_1_57FAA comprises a 16S rDNA sequence that is at least 99% identical to the sequence set forth in SEQ ID NO: 247;
(55) the *Lachnospiraceae bacterium*_oral_taxon_F15 comprises a 16S rDNA sequence that is at least 99% identical to the sequence set forth in SEQ ID NO: 251;
(56) the *Lactobacillus acidophilus* comprises a 16S rDNA sequence that is at least 99% identical to the sequence set forth in SEQ ID NO: 252, SEQ ID NO: 253, or both;
(57) the *Lactobacillus gasseri* comprises a 16S rDNA sequence that is at least 99% identical to the sequence set forth in any one of SEQ ID NO: 260, SEQ ID NO: 261, SEQ ID NO: 262, SEQ ID NO: 263, SEQ ID NO: 264, SEQ ID NO: 265, SEQ ID NO: 266, or a combination thereof;
(58) the *Parabacteroides distasonis* comprises a 16S rDNA sequence that is at least 99% identical to the sequence set forth in any one of SEQ ID NO: 272, SEQ ID NO: 273, SEQ ID NO: 274, SEQ ID NO: 274, SEQ ID NO: 275, SEQ ID NO: 276, SEQ ID NO: 277, SEQ ID NO: 278, or a combination thereof;
(59) the *Pseudoflavonifractor capillosus* comprises a 16S rDNA sequence that is at least 99% identical to the sequence set forth in SEQ ID NO: 292;
(60) the *Roseburia faecis* comprises a 16S rDNA sequence that is at least 99% identical to the sequence set forth in SEQ ID NO: 294;
(61) the *Ruminococcus obeum* comprises a 16S rDNA sequence that is at least 99% identical to the sequence set forth in any one of SEQ ID NO: 303, SEQ ID NO: 304, SEQ ID NO: 305, or a combination thereof;
(62) the *Ruminococcus bromii* comprises a 16S rDNA sequence that is at least 99% identical to the sequence set forth in SEQ ID NO: 299, SEQ ID NO: 300, or both;
(63) the *Ruminococcus lactaris* comprises a 16S rDNA sequence that is at least 99% identical to the sequence set forth in SEQ ID NO: 302; or
(64) the *Tannerella* sp_6_1_58FAA comprises a 16S rDNA sequence that is at least 99% identical to the sequence set forth in SEQ ID NO: 311.

16. The method of claim 7, wherein:
(1) the *Alistipes finegoldii* comprises a 16S rDNA sequence that is at least 98% identical to the sequence set forth in SEQ ID NO: 7;
(2) the *Bacteroides uniformis* comprises a 16S rDNA sequence that is at least 98% identical to the sequence set forth in SEQ ID NO: 45;
(3) the *Bacteroides vulgatus* comprises a 16S rDNA sequence that is at least 98% identical to the sequence set forth in any one of SEQ ID NO: 53, SEQ ID NO: 54, SEQ ID NO: 55, or a combination thereof;
(4) the *Bacteroides* sp_3_1_19 comprises a 16S rDNA sequence that is at least 98% identical to the sequence set forth in SEQ ID NO: 33;
(5) the *Bacteroides intestinalis* comprises a 16S rDNA sequence that is at least 98% identical to the sequence set forth in SEQ ID NO: 22;
(6) the *Bacteroides* sp_20_3 comprises a 16S rDNA sequence that is at least 98% identical to the sequence set forth in SEQ ID NO: 20;
(7) the *Bacteroides caccae* comprises a 16S rDNA sequence that is at least 98% identical to the sequence set forth in SEQ ID NO: 9, SEQ ID NO: 10, or both;
(8) the *Bacteroides faecis* comprises a 16S rDNA sequence that is at least 98% identical to the sequence set forth in SEQ ID NO: 13;
(9) the *Bacteroides* sp_3_1_23 comprises a 16S rDNA sequence that is at least 98% identical to the sequence set forth in SEQ ID NO: 34;
(10) the *Bacteroides* sp_D20 comprises a 16S rDNA sequence that is at least 98% identical to the sequence set forth in SEQ ID NO: 39;
(11) the *Bacteroides eggerthii* comprises a 16S rDNA sequence that is at least 98% identical to the sequence set forth in SEQ ID NO: 12;
(12) the *Barnesiella intestinihominis* comprises a 16S rDNA sequence that is at least 98% identical to the sequence set forth in SEQ ID NO: 59;
(13) the *Bifidobacterium pseudocatenulatum* comprises a 16S rDNA sequence that is at least 98% identical to the sequence set forth in SEQ ID NO: 113, SEQ ID NO: 114, or both;
(14) the *Blautia schinkii* comprises a 16S rDNA sequence that is at least 98% identical to the sequence set forth in SEQ ID NO: 130;
(15) the *Blautia wexlerae* comprises a 16S rDNA sequence that is at least 98% identical to the sequence set forth in SEQ ID NO: 133;
(16) the *Blautia* sp_M25 comprises a 16S rDNA sequence that is at least 98% identical to the sequence set forth in SEQ ID NO: 131;
(17) the *Blautia producta* comprises a 16S rDNA sequence that is at least 98% identical to the sequence set forth in SEQ ID NO: 128, SEQ ID NO: 129, or both;

(18) the *Clostridiales* sp_SM4_1 comprises a 16S rDNA sequence that is at least 98% identical to the sequence set forth in SEQ ID NO: 142;
(19) the *Clostridium lavalense* comprises a 16S rDNA sequence that is at least 98% identical to the sequence set forth in SEQ ID NO: 184;
(20) the *Clostridium innocuum* comprises a 16S rDNA sequence that is at least 98% identical to the sequence set forth in any one of SEQ ID NO: 179, SEQ ID NO: 180, SEQ ID NO: 181, SEQ ID NO: 182, or a combination thereof;
(21) the *Clostridium asparagiforme* comprises a 16S rDNA sequence that is at least 98% identical to the sequence set forth in SEQ ID NO: 143;
(22) the *Clostridium spiroforme* comprises a 16S rDNA sequence that is at least 98% identical to the sequence set forth in SEQ ID NO: 194;
(23) the *Clostridium hylemonae* comprises a 16S rDNA sequence that is at least 98% identical to the sequence set forth in any one of SEQ ID NO: 176, SEQ ID NO: 177, SEQ ID NO: 178, or a combination thereof;
(24) the *Clostridium sordellii* comprises a 16S rDNA sequence that is at least 98% identical to the sequence set forth in SEQ ID NO: 190;
(25) the *Clostridium* sp_YIT_12069 comprises a 16S rDNA sequence that is at least 98% identical to the sequence set forth in SEQ ID NO: 197;
(26) the *Clostridium paraputrificum* comprises a 16S rDNA sequence that is at least 98% identical to the sequence set forth in SEQ ID NO: 188;
(27) the *Clostridium glycolicum* comprises a 16S rDNA sequence that is at least 98% identical to the sequence set forth in SEQ ID NO: 173;
(28) the *Clostridium ghonii* comprises a 16S rDNA sequence that is at least 98% identical to the sequence set forth in SEQ ID NO: 172;
(29) the *Clostridium viride* comprises a 16S rDNA sequence that is at least 98% identical to the sequence set forth in SEQ ID NO: 200;
(30) the *Clostridium* sp_HGF2 comprises a 16S rDNA sequence that is at least 98% identical to the sequence set forth in SEQ ID NO: 193;
(31) the *Clostridium symbiosum* comprises a 16S rDNA sequence that is at least 98% identical to the sequence set forth in SEQ ID NO: 198, SEQ ID NO: 199, or both;
(32) the *Clostridium scindens* comprises a 16S rDNA sequence that is at least 98% identical to the sequence set forth in SEQ ID NO: 189;
(33) the *Clostridium disporicum* comprises a 16S rDNA sequence that is at least 98% identical to the sequence set forth in SEQ ID NO: 170, SEQ ID NO: 171, or both;
(34) the *Clostridium butyricum* comprises a 16S rDNA sequence that is at least 98% identical to the sequence set forth in SEQ ID NO: 150, SEQ ID NO: 151, or both;
(35) the *Clostridium orbiscindens* comprises a 16S rDNA sequence that is at least 98% identical to the sequence set forth in SEQ ID NO: 186;
(36) the *Clostridium bolteae* comprises a 16S rDNA sequence that is at least 98% identical to the sequence set forth in SEQ ID NO: 149;
(37) the *Clostridium* sp_7_2_43FAA comprises a 16S rDNA sequence that is at least 98% identical to the sequence set forth in SEQ ID NO: 191;
(38) the *Collinsella aerofaciens* comprises a 16S rDNA sequence that is at least 98% identical to the sequence set forth in SEQ ID NO: 201;
(39) the *Coprobacillus* sp_D7 comprises a 16S rDNA sequence that is at least 98% identical to the sequence set forth in SEQ ID NO: 206;
(40) the *Coprococcus comes* comprises a 16S rDNA sequence that is at least 98% identical to the sequence set forth in SEQ ID NO: 207;
(41) the *Coprococcus eutactus* comprises a 16S rDNA sequence that is at least 98% identical to the sequence set forth in SEQ ID NO: 208;
(42) the *Dorea longicatena* comprises a 16S rDNA sequence that is at least 98% identical to the sequence set forth in SEQ ID NO: 211;
(43) the *Dorea formicigenerans* comprises a 16S rDNA sequence that is at least 98% identical to the sequence set forth in SEQ ID NO: 210;
(44) the *Erysipelotrichaceae bacterium*_3_1_53 comprises a 16S rDNA sequence that is at least 98% identical to the sequence set forth in SEQ ID NO: 214;
(45) the *Eubacterium* sp_3_1_31 comprises a 16S rDNA sequence that is at least 98% identical to the sequence set forth in SEQ ID NO: 227;
(46) the *Eubacterium* sp_WAL_14571 comprises a 16S rDNA sequence that is at least 98% identical to the sequence set forth in SEQ ID NO: 229;
(47) the *Eubacterium limosum* comprises a 16S rDNA sequence that is at least 98% identical to the sequence set forth in SEQ ID NO: 222;
(48) the *Eubacterium hallii* comprises a 16S rDNA sequence that is at least 98% identical to the sequence set forth in SEQ ID NO: 220, SEQ ID NO: 221, or both;
(49) the *Eubacterium rectale* comprises a 16S rDNA sequence that is at least 98% identical to the sequence set forth in any one of SEQ ID NO: 223, SEQ ID NO: 224, SEQ ID NO: 225, SEQ ID NO: 226, or a combination thereof;
(50) the *Eubacterium contortum* comprises a 16S rDNA sequence that is at least 98% identical to the sequence set forth in SEQ ID NO: 217;
(51) the *Lachnospiraceae bacterium*_2_1_58FAA comprises a 16S rDNA sequence that is at least 98% identical to the sequence set forth in SEQ ID NO: 244;
(52) the *Lachnospiraceae bacterium*_9_1_43BFAA comprises a 16S rDNA sequence that is at least 98% identical to the sequence set forth in SEQ ID NO: 250;
(53) the *Lachnospiraceae bacterium*_3_1_57FAA_CT1 comprises a 16S rDNA sequence that is at least 98% identical to the sequence set forth in SEQ ID NO: 245;
(54) the *Lachnospiraceae bacterium*_5_1_57FAA comprises a 16S rDNA sequence that is at least 98% identical to the sequence set forth in SEQ ID NO: 247;
(55) the *Lachnospiraceae bacterium_oral_taxon*_F15 comprises a 16S rDNA sequence that is at least 98% identical to the sequence set forth in SEQ ID NO: 251;
(56) the *Lactobacillus acidophilus* comprises a 16S rDNA sequence that is at least 98% identical to the sequence set forth in SEQ ID NO: 252, SEQ ID NO: 253, or both;
(57) the *Lactobacillus gasseri* comprises a 16S rDNA sequence that is at least 98% identical to the sequence set forth in any one of SEQ ID NO: 260, SEQ ID NO: 261, SEQ ID NO: 262, SEQ ID NO: 263, SEQ ID NO: 264, SEQ ID NO: 265, SEQ ID NO: 266, or a combination thereof;
(58) the *Parabacteroides distasonis* comprises a 16S rDNA sequence that is at least 98% identical to the sequence set forth in any one of SEQ ID NO: 272, SEQ ID NO: 273, SEQ ID NO: 274, SEQ ID NO: 274, SEQ ID NO: 275, SEQ ID NO: 276, SEQ ID NO: 277, SEQ ID NO: 278, or a combination thereof;
(59) the *Pseudoflavonifractor capillosus* comprises a 16S rDNA sequence that is at least 98% identical to the sequence set forth in SEQ ID NO: 292;
(60) the *Roseburia faecis* comprises a 16S rDNA sequence that is at least 98% identical to the sequence set forth in SEQ ID NO: 294;
(61) the *Ruminococcus obeum* comprises a 16S rDNA sequence that is at least 98% identical to the sequence set forth in any one of SEQ ID NO: 303, SEQ ID NO: 304, SEQ ID NO: 305, or a combination thereof;
(62) the *Ruminococcus bromii* comprises a 16S rDNA sequence that is at least 98% identical to the sequence set forth in SEQ ID NO: 299, SEQ ID NO: 300, or both;
(63) the *Ruminococcus lactaris* comprises a 16S rDNA sequence that is at least 98% identical to the sequence set forth in SEQ ID NO: 302; or
(64) the *Tannerella* sp_6_1_58FAA comprises a 16S rDNA sequence that is at least 98% identical to the sequence set forth in SEQ ID NO: 311.

17. The method of claim 7, wherein:
(1) the *Alistipes finegoldii* comprises a 16S rDNA sequence that is at least 99% identical to the sequence set forth in SEQ ID NO: 7;
(2) the *Bacteroides uniformis* comprises a 16S rDNA sequence that is at least 99% identical to the sequence set forth in SEQ ID NO: 45;
(3) the *Bacteroides vulgatus* comprises a 16S rDNA sequence that is at least 99% identical to the sequence set forth in any one of SEQ ID NO: 53, SEQ ID NO: 54, SEQ ID NO: 55, or a combination thereof;
(4) the *Bacteroides* sp_3_1_19 comprises a 16S rDNA sequence that is at least 99% identical to the sequence set forth in SEQ ID NO: 33;
(5) the *Bacteroides intestinalis* comprises a 16S rDNA sequence that is at least 99% identical to the sequence set forth in SEQ ID NO: 22;
(6) the *Bacteroides* sp_20_3 comprises a 16S rDNA sequence that is at least 99% identical to the sequence set forth in SEQ ID NO: 20;
(7) the *Bacteroides caccae* comprises a 16S rDNA sequence that is at least 99% identical to the sequence set forth in SEQ ID NO: 9, SEQ ID NO: 10, or both;
(8) the *Bacteroides faecis* comprises a 16S rDNA sequence that is at least 99% identical to the sequence set forth in SEQ ID NO: 13;
(9) the *Bacteroides* sp_3_1_23 comprises a 16S rDNA sequence that is at least 99% identical to the sequence set forth in SEQ ID NO: 34;
(10) the *Bacteroides* sp_D20 comprises a 16S rDNA sequence that is at least 99% identical to the sequence set forth in SEQ ID NO: 39;
(11) the *Bacteroides eggerthii* comprises a 16S rDNA sequence that is at least 99% identical to the sequence set forth in SEQ ID NO: 12;
(12) the *Barnesiella intestinihominis* comprises a 16S rDNA sequence that is at least 99% identical to the sequence set forth in SEQ ID NO: 59;
(13) the *Bifidobacterium pseudocatenulatum* comprises a 16S rDNA sequence that is at least 99% identical to the sequence set forth in SEQ ID NO: 113, SEQ ID NO: 114, or both;
(14) the *Blautia schinkii* comprises a 16S rDNA sequence that is at least 99% identical to the sequence set forth in SEQ ID NO: 130;
(15) the *Blautia wexlerae* comprises a 16S rDNA sequence that is at least 99% identical to the sequence set forth in SEQ ID NO: 133;
(16) the *Blautia* sp_M25 comprises a 16S rDNA sequence that is at least 99% identical to the sequence set forth in SEQ ID NO: 131;
(17) the *Blautia producta* comprises a 16S rDNA sequence that is at least 99% identical to the sequence set forth in SEQ ID NO: 128, SEQ ID NO: 129, or both;
(18) the *Clostridiales* sp_SM4_1 comprises a 16S rDNA sequence that is at least 99% identical to the sequence set forth in SEQ ID NO: 142;
(19) the *Clostridium lavalense* comprises a 16S rDNA sequence that is at least 99% identical to the sequence set forth in SEQ ID NO: 184;
(20) the *Clostridium innocuum* comprises a 16S rDNA sequence that is at least 99% identical to the sequence set forth in any one of SEQ ID NO: 179, SEQ ID NO: 180, SEQ ID NO: 181, SEQ ID NO: 182, or a combination thereof;
(21) the *Clostridium asparagiforme* comprises a 16S rDNA sequence that is at least 99% identical to the sequence set forth in SEQ ID NO: 143;
(22) the *Clostridium spiroforme* comprises a 16S rDNA sequence that is at least 99% identical to the sequence set forth in SEQ ID NO: 194;
(23) the *Clostridium hylemonae* comprises a 16S rDNA sequence that is at least 99% identical to the sequence set forth in any one of SEQ ID NO: 176, SEQ ID NO: 177, SEQ ID NO: 178, or a combination thereof;
(24) the *Clostridium sordellii* comprises a 16S rDNA sequence that is at least 99% identical to the sequence set forth in SEQ ID NO: 190;
(25) the *Clostridium* sp_YIT_12069 comprises a 16S rDNA sequence that is at least 99% identical to the sequence set forth in SEQ ID NO: 197;
(26) the *Clostridium paraputrificum* comprises a 16S rDNA sequence that is at least 99% identical to the sequence set forth in SEQ ID NO: 188;
(27) the *Clostridium glycolicum* comprises a 16S rDNA sequence that is at least 99% identical to the sequence set forth in SEQ ID NO: 173;
(28) the *Clostridium ghonii* comprises a 16S rDNA sequence that is at least 99% identical to the sequence set forth in SEQ ID NO: 172;
(29) the *Clostridium viride* comprises a 16S rDNA sequence that is at least 99% identical to the sequence set forth in SEQ ID NO: 200;
(30) the *Clostridium* sp_HGF2 comprises a 16S rDNA sequence that is at least 99% identical to the sequence set forth in SEQ ID NO: 193;
(31) the *Clostridium symbiosum* comprises a 16S rDNA sequence that is at least 99% identical to the sequence set forth in SEQ ID NO: 198, SEQ ID NO: 199, or both;
(32) the *Clostridium scindens* comprises a 16S rDNA sequence that is at least 99% identical to the sequence set forth in SEQ ID NO: 189;
(33) the *Clostridium disporicum* comprises a 16S rDNA sequence that is at least 99% identical to the sequence set forth in SEQ ID NO: 170, SEQ ID NO: 171, or both;
(34) the *Clostridium butyricum* comprises a 16S rDNA sequence that is at least 99% identical to the sequence set forth in SEQ ID NO: 150, SEQ ID NO: 151, or both;
(35) the *Clostridium orbiscindens* comprises a 16S rDNA sequence that is at least 99% identical to the sequence set forth in SEQ ID NO: 186;

(36) the *Clostridium bolteae* comprises a 16S rDNA sequence that is at least 99% identical to the sequence set forth in SEQ ID NO: 149;
(37) the *Clostridium sp_7_2_43FAA* comprises a 16S rDNA sequence that is at least 99% identical to the sequence set forth in SEQ ID NO: 191;
(38) the *Collinsella aerofaciens* comprises a 16S rDNA sequence that is at least 99% identical to the sequence set forth in SEQ ID NO: 201;
(39) the *Coprobacillus sp_D7* comprises a 16S rDNA sequence that is at least 99% identical to the sequence set forth in SEQ ID NO: 206;
(40) the *Coprococcus comes* comprises a 16S rDNA sequence that is at least 99% identical to the sequence set forth in SEQ ID NO: 207;
(41) the *Coprococcus eutactus* comprises a 16S rDNA sequence that is at least 99% identical to the sequence set forth in SEQ ID NO: 208;
(42) the *Dorea longicatena* comprises a 16S rDNA sequence that is at least 99% identical to the sequence set forth in SEQ ID NO: 211;
(43) the *Dorea formicigenerans* comprises a 16S rDNA sequence that is at least 99% identical to the sequence set forth in SEQ ID NO: 210;
(44) the *Erysipelotrichaceae bacterium_3_1_53* comprises a 16S rDNA sequence that is at least 99% identical to the sequence set forth in SEQ ID NO: 214;
(45) the *Eubacterium sp_3_1_31* comprises a 16S rDNA sequence that is at least 99% identical to the sequence set forth in SEQ ID NO: 227;
(46) the *Eubacterium sp_WAL_14571* comprises a 16S rDNA sequence that is at least 99% identical to the sequence set forth in SEQ ID NO: 229;
(47) the *Eubacterium limosum* comprises a 16S rDNA sequence that is at least 99% identical to the sequence set forth in SEQ ID NO: 222;
(48) the *Eubacterium hallii* comprises a 16S rDNA sequence that is at least 99% identical to the sequence set forth in SEQ ID NO: 220, SEQ ID NO: 221, or both;
(49) the *Eubacterium rectale* comprises a 16S rDNA sequence that is at least 99% identical to the sequence set forth in any one of SEQ ID NO: 223, SEQ ID NO: 224, SEQ ID NO: 225, SEQ ID NO: 226, or a combination thereof;
(50) the *Eubacterium contortum* comprises a 16S rDNA sequence that is at least 99% identical to the sequence set forth in SEQ ID NO: 217;
(51) the *Lachnospiraceae bacterium_2_1_58FAA* comprises a 16S rDNA sequence that is at least 99% identical to the sequence set forth in SEQ ID NO: 244;
(52) the *Lachnospiraceae bacterium_9_1_43BFAA* comprises a 16S rDNA sequence that is at least 99% identical to the sequence set forth in SEQ ID NO: 250;
(53) the *Lachnospiraceae bacterium_3_1_57FAA_CT1* comprises a 16S rDNA sequence that is at least 99% identical to the sequence set forth in SEQ ID NO: 245;
(54) the *Lachnospiraceae bacterium_5_1_57FAA* comprises a 16S rDNA sequence that is at least 99% identical to the sequence set forth in SEQ ID NO: 247;
(55) the *Lachnospiraceae bacterium_oral_taxon_F15* comprises a 16S rDNA sequence that is at least 99% identical to the sequence set forth in SEQ ID NO: 251;
(56) the *Lactobacillus acidophilus* comprises a 16S rDNA sequence that is at least 99% identical to the sequence set forth in SEQ ID NO: 252, SEQ ID NO: 253, or both;
(57) the *Lactobacillus gasseri* comprises a 16S rDNA sequence that is at least 99% identical to the sequence set forth in any one of SEQ ID NO: 260, SEQ ID NO: 261, SEQ ID NO: 262, SEQ ID NO: 263, SEQ ID NO: 264, SEQ ID NO: 265, SEQ ID NO: 266, or a combination thereof;
(58) the *Parabacteroides distasonis* comprises a 16S rDNA sequence that is at least 99% identical to the sequence set forth in any one of SEQ ID NO: 272, SEQ ID NO: 273, SEQ ID NO: 274, SEQ ID NO: 274, SEQ ID NO: 275, SEQ ID NO: 276, SEQ ID NO: 277, SEQ ID NO: 278, or a combination thereof;
(59) the *Pseudoflavonifractor capillosus* comprises a 16S rDNA sequence that is at least 99% identical to the sequence set forth in SEQ ID NO: 292;
(60) the *Roseburia faecis* comprises a 16S rDNA sequence that is at least 99% identical to the sequence set forth in SEQ ID NO: 294;
(61) the *Ruminococcus obeum* comprises a 16S rDNA sequence that is at least 99% identical to the sequence set forth in any one of SEQ ID NO: 303, SEQ ID NO: 304, SEQ ID NO: 305, or a combination thereof;
(62) the *Ruminococcus bromii* comprises a 16S rDNA sequence that is at least 99% identical to the sequence set forth in SEQ ID NO: 299, SEQ ID NO: 300, or both;
(63) the *Ruminococcus lactaris* comprises a 16S rDNA sequence that is at least 99% identical to the sequence set forth in SEQ ID NO: 302; or
(64) the *Tannerella sp_6_1_58FAA* comprises a 16S rDNA sequence that is at least 99% identical to the sequence set forth in SEQ ID NO: 311.

\* \* \* \* \*